United States Patent 11,549,145 (METHODS AND COMPOSITIONS FOR INHIBITING AND TREATING NEUROLOGICAL CONDITIONS) - sequence listing, part 130

SEQ ID NO: 2397 - DNA, 440633 bp, Homo sapiens
cccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 2398 - DNA, 442331 bp, Homo sapiens
cctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 2399 - DNA, 24158 bp, Homo sapiens
cagcccagcccagcccagccccgcctcctacggccttccctagatcaggggccagggccaaagacctcccagcagaagaggagaagaggttgtgtgggacaagctgctcccgacagaaggtaccaggctgggggtggcagggctggaaggtcctggcctgggatgaagaggggactgcctaaggctggggtggctccaagatgctggcatgggaaactgggggtttcctggtaactggactcctagcaaactcccaaggattcaggtggggcccttctggactctaatcggcccatctctttccctttctgtgtggttaccaggttactggaggccacttagttgttggttttggttgggactttctggacttcagatctcagccctcgtttactcacccctgagccctccctgccctgcccccagcagttcctgacttcgcccctatacactgtccccggagctcttccctgggcctcaggtcctcaccctgcatcccctctgccctgcaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctggtgagtgtgacagcaaaatgtgtctggggtctcagggtggatggacttccagaggagcaggaatggggctcagtgagctaggtattgatggtggctggggtctgcgaccccagagaagcaagagagatggctcactcattcctctgctaactcactcattcctctacccactcactcctctacccactcactcactcctctacccactcactcactcctctacccactcactcattcctctacccactcactcattcctctacccactcactcctctacccactcactcactcctctacccactcactcactcctctcctcactcactcattcctctcctcactcactcattcctctacccactcactcactcctttcctcactcactcactcctctcctcactcactcattcctctcctcactcactcattcctctcctcactcactcattcctctacccactcactcactcctctacccactcactcaatcctctacccactcactcactcctctacccactcacacattgccctcctcactcactcattcctctcctcactcactcattcccctcctcactcattcctctcctcactcactcattcctctacccactcactcattcctctcctcactcactcattcctctacccactcactcattcctctcctcactcactcattcctctcctcactcgcgcattcctctcattcgcgcattcctctcattcactcattcctctcctcactcactcattcctctcctcactcttattcgtctgctcactcactcattcctctgctcactcattcctctcctcattcactccttcccctcatcactcactcattcctctgcccactcactcattcctctacccattcacttattcctctatccactcactttttgctctccccactcactcattcctctcctcactcactcattcctctcctcattcactgattcctctacccaccgactcattcctttcctcattcattcattcctctgcagttccatgccaaacctttctcacctccctgtcctcccacctcagcctgcttggatccttttcctgcctgtcttccctaccgtagtgcccctcccagaggctcctgtatggttgtggggtgcacagagcagggctctcctggcattcccaccttctccactgctggacttgaagccttctgagccccgatagacaggctgctccctgcatggcccatttgcttgtatctgcccatctctgggctgctgctttcccgcaggaattatctctgacttccttccccacggagggacacagctggaccagaagagaagtgcaggcagtctcccacaccctctccttccagggacaatgtgctcttccccagtaagatgtcccagtgagccctgtagcccaacctggatataatttggccactcccttcccctttcagaagccgtccttggtactcccaaacctttccctccgactgggaccggccctcccctttgggggatgtggcctctgtctgctcacttacaaaaggcaggattgatcggtgtgtccacaggtgcacaggaggcactagcacagaacctggcataagtgaggctctcctaggtgggagctgccatcctgatggacattagagtcacctctgctcccctggaggctgctgagaatggagggccctcaggacgcaggccctttgtctgtgggaggaaccagtgcccatgtggaccaaccaggacacaaaaggatatggcaaccagctctagggatatgtcctgaggccacactgctgcccacaaacctccttccatggggaccttcccatatagcaatccccagattgaaatcaatccaggatgagaaaacacatcctcttgagcagacagcttgtcttctctctctgctttggtatttacccttggatcttggggacagctccaagagagaaggagcagaagtcagcagaaacccactgcagctgctgagaatccagacacgctgctcactgcagaggctgcaccacatccggtggctgtggggggacttgctgtggcttcatctagggaggtgcattagtcagggttctccctagaaacggaatctccttagaaacagatagggtgtttcttcttatctctaatgcatgtatgtatggagacagaaagagatagagagataagaatttattatgggaattggataatgtgatgatggaggccaagaagtcccatgatatatcatctgcaagccagaaaccagggacactggtggtgtaaattcagcctgagtccagaaaggcctgagtccctggagttctgagggcaggagaagacggatatcccagcagcagaagagagagcaagttcttcctttcctctgccttttgtcctgttcatgccctcaatggattggatggggtctggcgtctcagggtgggtggacttccagaggggtgggacttccagtaggggttcagggagctgtgtattgatggtggctggggtctgggaacccagagaaccaagggagacggctcactcattcctctcctcacttactcattcctgtgcccattcactcattcctctcctcactcactcattctaataccaactcactcattcctctcctcactcactcattcctctcctcactcactcattcctgtgcccattcactcattcctctcctcactcactcattcctctcctcattcagtcattcctgtcctcactcactcattccttttctcactcattcattcctctcctcacccactcattcctctgcccactcactcattcatatcctcactcactcattcctctacccacactcattcctctcctcactaattccaataccaactcactcattcctctcctcacttactcattcctctatccattcactcattcctctcctcactcactcattcctctgctcacttagtcattcctctcctcactcaactcattcctcactcactcattcctctcctcactcactcattcccctcctcactcactcatttctctcctcactcattcattcctttacccactcactcattcctctacccactcactcattcctctcctcactcattcccttcctcccattcctttacccactcactcattcctctcctcactcactcattcctctcctcacttactcattcctctccccactcactcattcctctcctcactcactcattcctgtgcccattcactcattcctctcctcactcactcattccaataccaactcactcattcctctcctcactcactcattcctcccctcattcagtcattcctgtcctcactcactcattcctctcctcactcactcattcctctgctcactcactcattcatatcctcactcactcattcctctacccacactcattcctctcctcactaattccaataccaactcactcattcctctcctcacttactcattcctctacccattcactcattcctctcctcactcactcattcctctgctcacttagtcattcctctcctcactcaactcattcctctgctcacttagtcattcctctcctcactcaactcattcctcactcactcattcctgtcctcactcactcattcctctgctcactctctcattcccctcctcactcactcatttctctcctcactcattcattcctttacccactcactcattcctctacccactcactcattcctctcctcactcattcccctcctcccattcctttacccactcactcattcctctcctcactcgctcattcctctcctcactcactcgttcctctcctcactcgctcattcctctcctcactcactcgttcctctcctcactcactcattcctctcctcacttactcattcctctcctcactcactcattcctctcctcactcactcattcctctcctccctcacttattcctctacccacacactcattcctctcctcactcactcattcctctacccatgcactcattcttctcctcactcattccttcctctcctcactcactcattcttctgctcgctcactcactcattcctctgctcactcttattcttctcctcactcattcctctcctcactcactcattcctctcctcactcactcattcctctacccatgcactcattcctctccttactcactcattcctctcctcactcactcattcctctcctcactcactcattcctctcctcactcactcattcctctcctcactcactccttcctctccacactcactcattcctctcctcactcactcattcctttcctcactcactcattcctctgcactactatttccatcctgtttaccttcaaatgctaatctcttctcaaacaccctcacagacacacacagcaataatgtttgactggctatctgggcatcccttagcccagtctagtggacacctaaaattaaccatcacaggaagtgacagcccttgacttgctttcagatcactcctacagaggagggcttgaagaactcgacccagatgtcggccacctattcccagggctttacgatatggctgggtcccatcatccccttcatcgttttatgccaccctgacaccatccggtctatcaccaatgcctcaggtacccatgcagagcttgtggtggtgggtgccagaccaagcttctgtgtggtctctgcagtacccacgtccctccttgagtactcgtgcccctcattgagacttccttctcaatgtcttctccctccattgccatctgctccctgtcttggtgttctgggcaccactggggctccaagaggcctcaattcagggccctttctggaaggaacccccatgcttaaggacacgggtctagacagagacatttccagcctcatagggtcaggaatgggcaagagagagatgggtatgacaacacagagaactgggtgtctgctggggcaggctggaatgtttcctggaggaagagttgttggagctatgtctagaccaataagtaggattttttaagtgtggggcaggatgatgcagtgggcatcattggtatttggggtcccagccagtccttgcaccagccttgcccatccctcagtccaaagcggtaggaggatttgtggctggtggagaatctgggctgctatttatgtgacatccacctatgatgggtcagttccttctacctcatcctatcactcatccaccctaagtttcctgctctcctcctatgggcttcaggattctccaataggagaacccacaccagctgcttgacctccccttgctctctgctcttctcatccttggacacaccaggctgagctagggaagtggcagcatcccacaaaatctatggctctgacccccaaatccttagtgactctgtgcaggtcaccagctctctggctgctgaggtctctttcagttgtgagtgatggaaactcaacttcgtgtgctctaagcaaataaagagagtcaaaggagtgtaaatttcagggagggtggtcttcaggcatggctgaatccaggtgtcaatgaacattatcagggatctgtctccttttcttaatttcaccatttctctgcatcactttttcttttaaggcagccgttctcttatctgtcaaccatgggtcctagcagctcagttcttgtccgaaagctcaccttacccccaggggtcccataaatagccgcctatagtttcaatattatacctggttatatcttttctgtttaacctgggatcatatggagaagtcatcatgtgtgtggctcagctgtggtcgaggacacttggggcatgtcagagactttctggttcttctctgacatgtgatttgaaattgtcttttctcctccttgtcatctcttggccatgtttgtagcttgtccaaggtctgggagctagggtctctttggaattgtcagagttattattttagtctccctgagccaggtttcggaatccattctaatcacgcttgaagaaaactcttggttccacctgggacatgtctgggacatttaagaaatcacatttaaaccctatctggggcctgtctgtggggtacacagaggtcatgtcagactatctcaggtccatgtcaggagatgacagagagtgctatggcagacagggtgtccgaggtcctttaaaggtattttgtagagtgtggagctgtgttcagttgttgcagaacatgttgggatatataggagccatgtcaaggcgtgctggggtgtgctatgacctgttaggttgtgtcatagctttactgtgctgttgcagcctgggctggtccttcttcctctatcctcccttcgtcctttgcccttggcccccttcctgctatgctgggcatggagtggggaaagtgctggtaggcagccttgccctatacctgaagttcctctcttgccctctacatggcccctgatggtcctcgttcatgtcagctgccattgcacccaaggataatctcttcatcaggttcctgaagccctggctgggtgagtacctgcaggtgaaaggggttggggacaaccttgcggggagggtaggggaagtgctgctcttgcccactgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgtgagtcccttgaagtctgggtcccagatggagtcttggggtggagggaccatggacacatctggtctggaattttggctcttctgggtggcactgggccattgctcttcctctctgagccttggtttcctcatctgtaaaatggggatgataatccctacttgaaaggtcatttacttggcacacagtaggttctcagaaggtgtcagtttctgtgtttttctcacagaatccctgtaaactcaagagagtaaaaatgaagattgtgtagtagtcattgctgattataaaccacttcagaactcattggcttagagccataagggtttacaattgctaacgagtctgtgagacagctggccagttcttctggatgtggaagggatcactcttggcacatgagcagctgtgggtcggggggcagctttgctgatcctggctcagttcattcacgtttggggcttcagtaccttcagactcatctgggatgggctcagctgtgacacctggactttcccccatgtgattctctgcctccagaaggcaccctgttgttcacatggcagagactgggctccgagaaactgagaggaggctgcaatgtctgtggacattgtctctgcaatacttcaaagttcaaccaggtttgagtctattagagttattacatcatcatttcaccacattgtactggccaaagaaagtcgaaagtcaaaagtccagtacagactcaaaggggtgtaaaatagaacgcatctcttaatgggagttgctgaaaaattactgtggaaagggtacgaatacagggagaagtgaagaattgggggtcaggattttgtgaagtgtctaggatttgttttaaatatgcaaactgataagttagcttgttactgtctcatgcattctaacagattcctgggtcagagacaaagggtagttgattactcatggcacaataagcaacatgtacttcttgttggtttgtatcctttttctgagtcaacctaaattccatgggggtgacactggtgggcctctacattagcctgctcatgcagtacattgcatgacatacaatgggcattaggcttagggaatctactttaatagtggcagaaacaagcctgatattggtccaggaggagtcattgccttatctctccaggtggttatctgcaaatacaactctgagaaatggctcaggtaagaacatcacagtcttgcattggtggcatacgcagcaaggatgctcagggctgatgaagaagtgcctcttccaacacagggatatttttgaaatgaatttattacaatggagatgaataaagcaaacatttactcatcatatgcctgagaaaatgtcatgtcccaatgccaggatataagttgtctaagttaattttaataatcctgtgaggttatggttatttttgtcctattgcagatgatgaactgagggccagagagattagggagctggacagagttcaaccagccaggaagtgagctaggactggtggagcagagattctatcctggtttatctggccccaaagcagatcaccttgaccgttattgaatatttgacaggtgggacctagaggagggcaatatgttgaccaagggcacatagagcataggagacagagctgagacttgaatgcaggtctcttgactccaagccatgggtcttcatctcctatactaacagtttctgctcgcatcccagtctggtcctcgctggcaatgggttcctggggcagaggaccaggaggctggttgtgggggagtccatcctgatgtttgggactggggaggggcacaaaggaggcagggcccagctctagctctcttcccttctctggccaggacaagtggcagcacctggcctcagagggcagcagttgtctggacatgtttgagcacatcagcctcatgaccttggacagtctacagaaatgcatcttcagctttgacagccattgtcaggagtgagttccttcctagggcctgggatatgaatccatggaccaaagggagaaagttggggagggaggaatgagcaaagtaaccagaagtacctttcgggaggatttgtatcatagctgtgctttgaaggtcgaggaagaggagaaagtgctgtctttccaggtagaaatatgtgtgtaaaagcaagaaggttaggatgagccaagcatgtgcaagagacagtagaaatgaggttgtggaagtaggggctagatattaagggcactgaaaatcaggaaaagtggtatgaagtttatcaagacatttccagagaccttttgtagtttcagctgatgatggatgtgataagagctgagctgtgtgggaaactgatagcccaccaccacgcccagctaatttctgtattttcagtagagagggggttcaccatgttgtccaggctggtctcaaattcctgacctcaggtgatgtgccctctttggcctcagaaaatgttgggattacaggcatgagccactgtgcccagctgcttcttctttcttacagggtgaaagagagagggagagagagagagacagagagacagagagagagagagagaaagagagagagagttggttatgctgggggctggagcagggctgaactggaagaggatgaagtctgagttgtgtggacagttttggtaaggaaaatgatcagtactgcatactggatgggagacagaggagagaagcatggtgtccaagctatactctaggtgcctaggtgcatggagacagctctctcagagataggatgcagggagagaagacagtctagagagtcagtctcatgactgatacccaccatgtatctctaggaccatctatttctagatactcagtttcctgatgggaggtagctcctggctgctggtgggaggtgttcctggggctttgcatacgttacattgttgcctccctttctgcccttgctctgcaggaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggtaggtttctctatgatctgaatttaggtgagagaatagagcttcatgtcaaatgtcaggtgaaataaattggttttgatccaaagggcactgggagccatggaagatgcttgagaaagggaaggtcacagataggttttagagatgactttattgcatgcagcccacagggcactgctaattctgaaactgtgaggagcatgatattttattcaacttataagttagtgtgttagtctttcacatttttatgtgtatctatatgtctatgtctttgtctatgtctgtatctatgataaaagatgcaccaaacccctggatcacagcagcccattaattatttacagcagtaacagcaggtggagtaggatggtagtgctggctccccattcctagggcaacacaatgtttttacctgtaaatgcacaagaatttgcaccaaggagaggggcccccacattatgagtattatagcttatataggacagctagctcatatgctccttctttattacagggtgaaagttagagacagagaaagagagagagagagaatgctttgttctggcgtataaactacccctctcctgtgagatggcaatttctagagttttataacccaaatatcttctggaaagataagattctctgggtttaccactctagaatgtcagcaaatatttttggagcaatacataatttctaacctccaaggcaaattgccattcaaatatcctgtaccccaggttgccagtatctttttctctgaaagtctgtattatgcagaaaaatgaaaatattcgagaaccattgattcctgtcaccagggtccaaagaggaggcaaaggatctgggggaagcccttggagttggggctttggtgatggtgaacaagagagatctagacgtgcagagtgcatttgagtttctggaagatcagagcttcagagattatctcaggttagactccggagtctcagagatagtataatttgtgtgtgtgtgtgtgtgtgtgtgtgtgtgtgtgtgtgtgtgtcttgctttctcttcaggatgaagatgggaaggcattgtcagatgaggatataagagcagaggctgacaccttcatgtttggaggtgagggtcccagtgtgggactacagtggagacagaggtccctccatctcaggatccgggtgggtggaccctggatcactccattctgcccatcttccccctccctccatcctcctgagggcctcaatatctgggcgctgtccaccctccggtgctgaagccaagcttacctggctgctcctcaggccatgacaccacggccagtggcctctcctgggtcctgtacaaccttgcgaggcacccagaataccaggagcgctgccgacaggaggtgcaagagcttctgaaggaccgcgatcctaaagagattgaatggtgagtgcaagttcttctggcctgttcctgagcccatcattggttctgctccccaagtgaggaggggtggaggagttgttttgtggattcttccactattgcttagtgggtataaaagcagaggaccacaggcagggcttgataccaagcctggctgtcaggggaaaagttgcaggcctttaggaccgaaagacccgggctgctaagagaattggtgacaatgtgtgaggacagataatgctactttgcacatgttcagcaaatgaacttcccctccactctgtttctgttctcccagaaatatcagttttttcgaaaatcctcacttcttgaatgtttgctcaggtggggagggagaagttgtttttgtcaattcttccattattgcttagtagtactaggagcagagcacagaggcagaacttggtatccaacctggctagcaggggaaagttttcagacttttgggacagagagtcctagcccgctgagagaactaaggacaatatatgaaggcagacgatgacatctagacatgttcagtcaatgaattttcccttcactcctttcttgtttactctgaattatcatatttttttcaaacatctttacttcctgaatgtttactcttctgttccctaattcctaccctccggtccagtccagggagtcctaagggagacctgggggtaaaagtcatctatcttttgtctagaacacctgcatcgttcatccattcagtcttcattcagcaaactcttccacatgcctttccattgccagttctgttcccacacctttctgtgctctggagacctggaaagaaccctgcctatggatgtgttttccaggtactcccagcctagtaggaacagtcccccacaagacattcccagtccacataggcaaggatggagttgagagcaagagaagcatggctgggagtacagaaagtgtgatagaaagtgtttcaagccagatctggtggctgtcgcttgtgataccaagtaccgaggaggctgaagtgggataatcacttgaggtcaggtttaagatcaacctgggcaatatagaaagaacccatttctaaaaaagtaaaaaaccaaaataataaagtgcctcaactgaaaccctgaatggtgatcagtaggtgtttggatgcagtagtgccctaggtcaaaaagaaagtctgggcaaaaatgcaaaaagagggagcaggagagagggagaagagggaaagagaggtttgtgtgtcagggaaggagatggttataaagggagggagaagtaagagggaggaaaagtgagggagagcaagataaagagaggagggaagacagaaggagacagagagagaatgagagagaaaggaactgagttgtgatgagataataactatggtagtgaaagcagagtctggctgtggaaaatatgggaaaatggtaatggcttccattttaacccaaaggcaatgggaagccataacaagtggttgagcaggggaggggcaggtcatatctgggcaccagaaagatcttttcagagctactgtggagagaggaccagctgtagaatgaagtcccagtgaagacattctgggacctgagccagggcaggggctggggatggagaggaggcaatggactggacatgtgttttggaggccgtgtcctcccgtccaagcctttgctcagcacagcagtcctaaaaggtggcaacactttttatgcttttaaaaaccaagatatcaagtaatactgtgcactttgtaaacaaaaaaaagtgtctaaaacatttataaaaatgagctttcctcatgcctgtaatcccagcactttggaaggccgaggcgggcggatcacgaggtcaggagatcgagaccatcctggctaacacggtgaaaccccgtctctactaaaagtataaaaaattagccgggcgtgatggcaggtgcctgtagtcccagctactctggaggctgaggcaggagaatggcgtgaacccgggtggcggagcttgcagtgagctgagatggcaccattgcactccagcctgggcaacagagtgagactctttctcaaaaaaaaaaaaaaaagagcttccttcttaactgtcaccctagtagtttctaccatcaatggttttgtgtgtccctccagaagatggctatcttgatgcccactttataagaacacagacttcttctatacaaataagagtgtataaaatagacacagtactttttcccaagatggtgggttggaggcaatgtcagtgtgcctctcccatgtggaaggacagaatagtgtgtagagattcacagtgtaagctttcttttcccaagaaacaacacagggacttaacaggaaaaccagaagaatccacaaacccttcaaaagaagctacaggctgcattctactctgtgagacaggtgaaaaactgtgaatcctcagagtaagagggggagagactgcttcctaggtacacatcttcactggggaatctgaaaatccagaccacaggagaaggccttaactctatccagggcttgaactgatttagggagtggtaagaaatataaaagtagaagcagcagcaggaagtcccttgcaggcattcacaatctccagcatggactgagggaagccattccttattgtatctcacaggggaccttggggaagtcagacaactagctcaggtgaggtcacaggttgaacgaaatgcccaaatgaatttcttgatataacctcgagtggggatgaactcccttgaccagaacccgggaggcaagcaggaagtgtgctgcagacaggagttcagaagctgggtgcctggccttggacagggacaaaaaaggacatggcctgaaagcattgctatttctgtgggaaaagcttatggcctggggcagggctgagttctgtgcacagactgcctggatctaaatccagtgctatgagtggaacactgcatgtgtgagacccaccttgtgccaactgcatgggagctagatgaggcttactgccacctgctactctccactcccttgtcaaactcttctgtgaggcagaggcagttatactcacctctggatcattaccccagtgacctaagaaccaccctctgactctcacagggcaaaacaaacaaacaaaaaaacagttgcaaaaaaaaaaaaatacctaggaatatacttaaccaaggaggttaaagctctctacaaggagaactacaaaacagtgctggacaaaaccatagatgacacaaaccaatgaaaacacatcccatgttcatggattggaagaatcaatattgtgaaaatgatcatagtgcaaagcaatctacagatttaacgcaatgcctatgaaaataccttcatcatttttcacacaactgggaaaagcaattctaaaattcatatggaaccaaaacagagcctgtgtagtcaaagcaataccaagcaaaaagaaaaaatttggaggcatcacattaccggacttcaaattacattacaaggctacaattaccaaaacagcatggtactggtataaaagtaggcatttagatgaatggaacagaaaggaggacccagaaataaagccaaatacttacagccaactgatctttgacaaagcatacaaaaacataaattggggaaagacaccctattcaataaatggtgctgggaaaactggacagtcacatgtagaaaaatgaaactgcatccccatctctcaccttgtacaaaaatcaaaggcttaaatctaagacagaaaccataacaattttataagataaccttggaaaaactcttttggacattggcctaggcaaagaattcgtgaccaagaccacaaaagcaaatgcaacaaaaccaaaaataaatcagtggaacttaattaaactaaaaagcttctgcacaacaaaataataataataataatagccgacttaacagacaacctacagagtgggggaaaatatttgcaaactatgcatctgacaaagggctagtatccagaatctacaaggaactcaaacaactcagcaaggaaaaaaaacaaacaaacaattagttccatcaaaaagtgggcaaagggcatgaacagataattctcaaaagaagatacacaaacagccacgaaacatatgaaaaaatgctcaacatcactaatcatcagggatatgcaaattaaaaccacaatgagataccatcttgtttctacaagaatggccataattaaaaagtcaaaaaacaatagatgtatgttgtggatgtattgaaaagtgaatgctcatacactgctatgaaaattaacataacctctgtggaaaacgataaggatattccttagcgaactaaaagtaaatctaccattccatccagcaatctcactactaggtatccacccaaaggaaaagtgattatatgaaaaagacacatgcacatgcatgcttatagtagcacaattcacaattgtaaaggtacggaaccaacctaactgcccattgaccaatgagtggataaagaaaatgtggcatatatacacaatggaatactactcagtcataaaaaggaatgaaataatgtcttttgccgcaacttggatggagctggaggccattattctaagtgaagtaactcaagaatagaaaaccaaataccatatattttcacctataagtgggagctaagctgtgaggacacaaatacatacagagtgatataatgagctttggagactcggagagcaaggttgggagccgggtaagggagaaaagactgcatattggggacagtatacactgcatgggtgatgggtgcactaaaacctcagaattcaccactatagaaatcatccatgtaaccaaaccacttatatcccaaatgctattgaaataaaaggaagtaaagaagagacagatctgcacattaacaatatatctttgggagcttttctttttctaaaaatatgagttttggaaaattagttcgtttttatttttaattggcaaattttaattatatatgtttatggggtgcaatgtgatattatgatatatgtatacaacgtggaatgattaagtcaatttaataaacatacccgtcatctcatatactcatcatttttgtggtgagaatatttgaaatttgctctcttagcaattttgagaaatttattattattaactgtagtcaccatgcatgcaatagatctcaaaacttattccttctaacggaaacttgtaccctttgaccaatgtctttccattctttcttcctcccttctctggtaaccaccattctcttcttggtttctatgatttctgtgttaattatttcagatctcacagttaattaaggttatgtgctgtttgtctctttgtgcctggctcatttcacttagcataatgtcctttaggttcttgcagattgccacaaatgaaagaattttcttctgttttaaggctgactagcattccattttgtatatatacaccacacggaaaatgagttttgaattacaaaagcaatgatgagaacagtttcttcttgcactcaatgaggcatcacagatagacaagggttattcttgacattcctgctatcccacctaatatcctccctttctccaagggggcctgtagagatacttatttgtcatctatctgtctgtctgtttacatctatctacatatctttctatcatcgatctcttcttatattccttatattttttgtcctatggtatttacatatatggacatttgggaacatgtttttttccactcaatactgtgtctgacagatattttttctgagtgctgaatagcattccatgttttatttggcccatccctttgttgaagacacttgcgtaaacatttccaatcattggaggtatggccaatttgcattccagagtctctgtactgatttagcttctggtctgcattgtgtgacaggactagtgatcctttttttctccttttgtgtagctgtatactattccattgtgtggatgtttatctaaacatctccccatccatgtatatttggcttgtttcatccttttgctaaattaaacttgtgcaatcggcatgtgtgtacagtgagcattgctcatatgtataaacatcactgcaggacaaattcccaaaagtgcaattgttgaaccaaagaccatttgcattctacagttgtaataatgattgcaaatccatctctatattaggtgagtttgatggcactagctttcccacaaatttgccaatagtattattgtattattaaatttaaattttttgtccatcttcatatttcatcttttaatgagcattttcttaaataagagtgagaaagaacatcctttgcccaagttgataagccatttattttctttctatgggagtggtcatctgatattttctgctgtttttctttgggttcttttttcttatttacttataagaatgtgtatcacaattaatgttttttttttctgtttttttgttgcaaaagattgccttttgacttttttggggggtgcttttggttaatttttatgaagttacatttgttcgtattttcttttgtaccacactacccagctatttcccagagttttgtggggcttcctttggcagatgggaagtttccacttattcacatgcccgtctctgacctttttagtcttttgaatgcatccgtttttatggcattgccagactattttttcttactgtgacttttcttttcttttttctttttttgagatggagtctagctttgtcgcccaggctggagtgcagtggtgcgatctcagcttactgaaacctcctgcctctctggttcaagctattctcctgcctcagcctcccgagtaactgggactacaggcaccctccaccacgcctggctaattcttgttttaggtagagatgaggtttcaccacattggtcaggctggtctcaaactcttgacctcaagtgatccacccacctcggcctcccaatactctgactttctaatgggttttaatatctggcagagtggctttttttgttgttaaatcaacccctgcaaacatttattgtgtgataaagtgtatgttttatttggattgagggaaatttataatgaaatacagagatttcatgtttctttttaagtttaatccaggtattttatattattatgactagtatcttttcttttattatcttttcatttgatggttatttctatatggtaaaactaatgatttatgcatataaattctatgcccagtgaacatagtatatgctaaagatggtatctgtatcaagagaaaaaatatagataattaagtaaaagctcttggggcaactggaaagccttctggaaaaaaggcaactgaaccttgttctcatatcttatgacaagataatgttcagattaatcatttttttctaaaagagtcctaaaagctctagaaggaaccatgagaaaattatttcatagcgccagagtagggataaccttattttgacgtaagtcccaggggctatgaaaaagtgataaactgttaaatgagagaaaagatacacgccagccacggtggttcatgactgtaatcccagtactttgtgaggccaaggtgggcagatcacttgagatcaggagttcaagaccagccttgccaaattggggaaactccatctctactaaaaataaaaaaaaaaattagctggctgttgtggtgaatgcctgtagtcccagctacttgggaggctgaggcagtagaatcacttgaaccagggaggtggaggttgcagtgagacaagattgtgtcactgcactccagcctgagcaacagagactccattccctccccccatcaaaaaagatacagaatagtgtctacagtagatggtgtgctcctatataattttttaagatgcttaaaatcagcccagaaagcatacattaaaaaaaataataacctggcaacgtgtggggagaagtaaatggcattgggccataggagtgaattatgttttatagttttcaaattctgaaccagataattgtagacggtatgaaaattttaaatagccactgcaaaagaagaaagattaagcagagaattcagctcctttgcttgatcttaaatgtttataaacgttttccagtggggcctctagtgttttctaagtataaaatcactatctgccaaaatgatacatttactaccacatttcaaattgcctgactctcgtgtttttttggctgcataaatgtcttcttttgagaagtgtctgttcatgtccttcgcccactttttgatggagttgtttttttcttgtaaatttgtttgacttcattgtagattctggatattagccctctgtcagatgagtaggttgcgaaaattttctcccattttgtacgttgcctgttcactctgatggtagtttcttttgctgtgcagaagctctttagtttaattagatcccatttgtcaattttggcttttgttgccattgcttttggtgttttagacatgaagtccttgcccatgtctatgtcttgaatggtaatgcctcggttttcttctagggtttttatggttttaggtctaacgtttaagtctttattccatcttgaattaatttttgtataaggtgtaaggaagggatctagtttcagctttctacatatggctagccagttttcccagcaccatttattaaacagggaatcctttccccattgcttgtttttctcaggtttgtcaaagatcagatagttgtagacatgtggcattaactctgagggctctgttctgttccattgatctagatctctgttttggtaccagtaccatgctgttttggttactgtagccttgtagtatagtttgaagtcaagtagcatgatgcctccagctttgttcttttggcttaggattgacttggcgatgcgggctcctttttggtgccatatgaactttaaagtagttttttccaattctgtgaagaaagtcattggtagcttgatggggatggcattgaatctataaattatcttgggcagtatggccattttcatgatattgattcttcctacccatgagcatggaatgttcttccctttctttgcaccctcttttatttcattgagcagtggtttgtagttctccttgaagaggtccttcacgtcccttgtaagttggattcctaggtattttcttctctttgaagcagttgtgaatgggagttcactcatgatttggctctctgtttgtctgttattggtgtataagaatgcttgtgatttttgtccattgattttgtatcctgagactttgctgaagttgcttatcagcttaaggagattttgggctgagacaatggggttttctagatatacaatcatgtcatctgcaaacagggacaatttgacgtcttcttttcctaattgaataacctttatttccttctcctgcctaattgccctggccagaacttccaacactttatgcagccaaaaaacacatgaaaaaatgctcaccatcactggccatcaaagaaatgcaaatcaaaaccacaatgagataccatctcacaccagttagaatggcaatcattaaaaagtcaggaaacaacaggtgctggacaggatgtggagaaataggaacacttttacactgttggtgggactgtaaactagttcaaccatggtggaagtcagtgtggcgattcctcagggatctagaactagaaataccatttgacccagccatcccattactgggtatatacccaaaggactataaatcatgcggctataaagacacatgcacatgtatgtttattgcggcactattcacaacagcaaagacttggaaccaacccaaatgtccaacaatgatagactggattaagaaaatgtggcacatatacaccatggaatactatgcagccataaaaaatgatgagttcatgtcccttgtagggacatggatgaaattggaaatcatcattctcagtaaactatcgcaaagacaaaaaaaccaaacaccgcatgttctcactcataggtgggaattgaacaatgagaacacatggacacaggaaggggaacatcacactctggggactgttgtggggtggggggagggggaagggatagcattaggagatataactaatgctaaatgatgagttaatgggtgcagcacaccagcatggcacatgtatacatatgtaactaacctgcacattgtgcacatgtaccctaaaagtataataataataaaaaaaaaaaaacaaattgcatgactctccttttttcccttgcctaattgcacttgctggtatctctagcatcacgctaaataagagcaaaacattggatctgggtattttgtttgttattcatttgcatttgagtttgctttcttgccatagacaatatttatttttatgtgagtttgttaattttttaccgctggcttctgggtgttttcctcagagtatttatttttatctatttggctaaattttctctggtacttttctaattctctgcttctctaattgttttctgctttttaaaattctcaaatgtttgatccccgtggagtttattttgtgatagggagaaaaggtctcatttgcaaatagaaaaggtggagagttgtgtatttgttcccttgataatgactggggctggggtgtttccttagggacgacctggcccagctgcccttcctgaccatgtgcgtgaaggagagcctgaggttacatcccccagctcccttcatctcccgatgctgcacccaggacattgttctcccagatggccgagtcatccccaaaggtgcccacagcctcagggggagaagcctcccgggtaggaagatggttccctcaggggatccttgtcctgactgcccctttctctcccacaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggtaagagcgccctgtgtctgaggcagggatgggatgatgggtgcgggagttaaaaaaagggggacgttgcagatggtcccagttccagctctccttccctccattccttcacagtttatgggaaaacgtccatagaatggggatgagtaggtcctagaggggtccgcggagtgctcaaaatccccttctccatctgctggtctgagctgggagctggagtcaggcccagtctccgggacatacaagcccacatgggagtcccaggcacgcttagtctttctctctctctctcaggctgagctgggtgcagttgggggtcccaggccaggttcctgggttgatgggacccaaatgcgggtcttgggcacagtcacagtccccactcccgcctgcaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacctctgcctgggcctcactgacagcctgcag

SEQ ID NO: 2400 - DNA, 207075 bp, Homo sapiens
gctttccggggccggcagaggaggatctaggtagagtacagacgtcagccccgctctggcggggcccggacagaaccgggcatgctccgggcacctcccatcatgcggaccgtcccacaaacacacgttagcatgtttagaaagggagctaagaagaactaagtacaatgcggcacttttttccaaaaataatagtttttaagcattacggaagtgctaggtgaggaagggctgctcctggccctcaggaactgaggcagccgttcacataaacgatgcatgtctccagaggtgaaggacccctccttcccttgctcctctgtgtctaaacatattctaagcaaactcaggaagcagggtgttcccgcatttgcatttttcatgtagaccttccttggcaggaagcagctcatctctccagctggccccacacactggggtctggatgctgagtatgactgtgcgcttccttccaagggccctgcgagaggctgccacgacacactttccccgatgctggttcaaatcacgtggaaatttcatttctgagctgccaccagcacagcaaagctggtgccatatttgccatcagtcttttgacatggagctatgcttacaagaacaaggcccaatgcttctgttaaagatgtgaaatgttgaatacatctgacatcaaactgttgaataaaatcaacgtcaaaccacagctgaagacggaagccccatcagtggctctgtctgtggttattctctaacctaaaagaggtttgttgctgtctgtggttattctctaacctaaaagattgtcagcctctttctcaagccactgacagctgtctgcagtgacagcactcagggctgggtctcggatcataagttcaatttatatttaaatgtacatttttaaaaacgtatttcagacttttagccagtgcatctattgctggtttgatttgcctaaagaataatatcgaaaattgaaggagtccactttgtataaagctgtgatttttgttaaagaaaactacagccaaaaagtgtttgcttttcaatataagatgatggaaatgggtagagttctaaaggatgaccgtccattatccactgcaactgagtcctagatttgttgctaactgacgttctacacagcctttcttcactcggaaatagacgagtgaaagtatttcgacttctcattaggaaggaacagtggctatcatgtttgaataattatgcatctgtttttttaaacctcagtctggcaatactccatcgcgatgaatcttcactactcagcctgcctggggaggcttccaaatgcacgggactcatttgacgtttgttttcttgaggctttggaggtagctcagctgcctttgcactgtctctggacaatgttaatgtcatagttgtgtctattccagttcttctccatagcagcggcgcccacgtgccccaggggccttctctggggcagcaggaggtacctggggtggttctgcttgggctcaggcacagtgaaaagaacctggaggctggagcagggggcacagaactgaaacaagagtgcaggagtcactctggggaggccagctttgcctggattctgaccctggactccgtggttgagagtttgtttgttctgcagccacacaagtgagcatcgagggatgaggctggggggcgaaggaggcagaatgtcacatgggtggcttggtgaaggctggattgtagggacagaaagcattttttcatcttagccctttgtaagtaagttcaacagcattaaatgcattcatgttgctgtatagccgtcagcacctctgtctctagaactttttcctcttctgcaagtaaaactctgtccccatgaaacactcagtccctttcccctccccagccctggaacccccattctgctttctgtctctgaaactgactcctccagggccctcctagaagtggaaccacacaggatttgttgttttgtgactgctcatttcacatggggtaatgtcttcttgttactgcatgtatcaatgtgtcacacgccctttctgttgaaggctgagccacactgcactttgtggatggaccacactggtttccattcctccgtggacagaccccgggtcgcttctccttggccagtgtgaatggtactgctgtgaacacggagtgcagctctctctccacgtcactgttttcggttcatttgggtaaatgtccagaagtggaattggtggatcccatggtgaagcgatgcttcctcgttttgaggaacctccacactgcttagggacagggtgtgctttgcgagctgcctctacagtcttgccatggggtgggggttggccattgtaagaatgagaagggtcagatgttagaagctctggaaagaaggaaatgagagaatttggtgacggttggctgagaggaccctcaaacacgtgcctggctttcccctcttggggtggtacgtgggtggaggactctggagggagagggaggaactgctgtagccatctggtgagcccagggacctgaagcagccaggtgcaggcacacggtgacctggagtcacaagatttgtgcagaagtgcacctcgtgaggaaggtggacgcattggttccagggaggccttttagcccattcgtgcaaatattaggtcttgaccctggttctatgtcagtcaggatcacttggggaaagtttaaaaacataccagtgcccaggccccacctgatgtatttgtctgagaaaggacttggccattgtcgtctttaaaagttctttacctgatgcttttttttttaatggaagaaacgcttcttgttttactttaaaaatattttttctagctttattaagttatattcacggatataaattgtgtgtatagtatacaacgtgatgttttgatacaggtatacgttgtgagataagtcaacaaagctagttaacatcttgccacctcacatccttatcatcaccttgtgcttttaagaacatttaagatctcatctcttagcagttttcaagtaaacaaaccatttaactgtggccaccacgtggtaccatagacctcgtcacttactcctcttgtctaactgaaatgctgcacccttccgccaacatcctcccagttccccccaaccctctctctgttgaccactgttctaccctctgcttctgagttctatgctttcagattccacgtgtaagtgaggtcacgcggcacctgtctttctgtgcctggcttgttccacttagcatgatgtcctccaggctcatctatgttgttgcaaatgctaggatttctcactttttaagactgagtaggtattccacattttctttgtctgtgcctctgctgatgggcttgaggttggttctgcgtgttggctgtggtgaacagcatcttaacgaacacgagagagcagataccccttccacacatccattttattcccttcagaaaaatacccagaagtgggattcctggattattcctttatcattctaatgtacccctaggattgagaatcctgatataaaacatatgaaaggataattaagagaaaaagcaaaaaacacaaaaagaaaggaaggaagaaggaaggaaagagggagggaaggatatctgagttatgttcccaacactatcataacaacattgggagcaaatagcattattttagacatttgtttttccaaattgagtgttccaatctcctcatctttaaattgagagggttaaatgatgatttttaagggatcttcccagtcacgaatttatggatctataattctactgggtcaaattaaaattaaaaacacttcataatgatcttgatgctattatagtgaatgagtaactatcatttccaaaatgctgtgggacattttacagcacagtataggttaaagtcataaagcaatgaagtgacatttgcttctggtcctatttcaaagcatcaatcttttttttccaactcccctcagtcttcaaaagctccaaggaaagctgagtagcattggctgaagagcttaagataccattagtgccagatgaattaataaaaccgcccacacttgtgttattagccattacctcttaagagcatttgcgttctctgaagctcatagagtgtaatgtatgaaaagtaattttatgatggggaaaatggctgtgaaatataggaggataaggaagttttccataaaattaaagtcactgataaaatgaattaatgtagcacattcaaaacgaataccttgaaagagaaaaacctcactttttccagaagaaatgtttctagggaagaccttcagacacactagaattaaattgctctcttaataacttttgtaacattggctcattatgacgttacttctaagaatggcattttttcattttcccgaatgttatatttaaatcagctgtaaagagttggtgatttatttgcatctatgaagagtgctatattgacccaaattttgcattgataaatgaatgcaaaatgaaattttaaaaagttggcagattaaattatcaaagtatattaagcacatattatatatgcagcacaacactgagaaaatgtacacactgtgtaattttgaaatacctgaatattaaaataatacttagagccttccacctggcaggcacatagattgtgaacatgtttttatataatagaacatcagctagcatagctttaatcatctccacagcatttaagtgcaccaatgtctcattctaatgttaatacatatcttgtctcacaggaattccccttgggatgtttatttttgtgtgttctttcaaaaaacaaaaacccagctctacctatacttgtcattttatcgtccatacttattttcttcagggaaatttatagaaatagcggaagtgtattacattgtaggttcttggtctcactgacgtcaagaatgaagctgtggaccttttgggtgagtgtccggagtttgttccttttaatgttcagacgtttttggagtttcttccttctggtcggtttgtggtctcaatggcctcaggagtgaagctgcagatcttcgcggtgagtgttgcagctcataaaaggagtgcggacccaaagagtgagcaacagcaagatttagtgcatacagcgtaaaaattaagcatccacactgcccaagacgatctcagcaggttgccagtgccggctcaggcagactgcttttattcccttatctggccccacccacatcctgctgattggtccattttacagagagctgattggtctgttttacaaagagctgattggtctgttttgacagggtgctgattggtgcatttacaatccctgagctagacaaagagtgctgattggtgcatttacaatcctctatctagacataaaagttttccaagtccccactagatgagctagacacagagcatagattggtgcatttacaaaccttgagctagacacagagtgctgattggtgcatttacaatcctctagctagacataaaagttctccaagtccccaccagattagctagatacagggtgctgattggtgcatctacaaaccttttgctagacacagagttctcattggtgcatttacaatctcctagctacacataaaagttctccaagtccccaccggactcaggagcccagctggcttcacctagcggatcctgcgctggggccacgggcagagctgcctgccaggcgcctgcactcctcagcccttggagggtcaatgggaccgggcgccgcggagcagggggcagcgtccatcagggaggcttgggccgcgcgggagcccaccgcgagggggaggctcaggcatggcgggctgcaggtcccgagccctgtcccacggggaggcagctgaggcccggggagatttggcgtgcagcgccggtgggccagcactgctgggggacccagcacatcctccgcagctgctggcccaggtgctgagcccttcactgccccgctggcgctggccggccgctccaagtgcggggccgcggagcccgcgcccacccagaactcgcgctggcccatgagcccacacctctccctccacgcctccccgcaagcagagggagccggctccggcctcggccagcccccagggcagtggctggctgaagggctcctcaagtgcggccggagtgggcgccgaggcggaggaggcgccgggagtgagtgagggctgccagcatgctgtcacctctcagaagcagtgatgtgctgagcttctgtctagaaagaaggtagcagtccaccctcctgtctcccaggcattcgttcacccaggtcctcagccaccgagtcttcctccttcacccacgaccctccttcacccaccaccctccctccacccaccaccctccctcccaggcatcctgtagcctccaccaccacacttcctgggaggttcaggcttcagccttgaccttcctgcactgcccaatgggagcatcgtgaccacacattttaggagaaggctccttccccactgtgacatcaaacacgtggtcacatgaaaggcctagtctgtggcacaggaaaggggccctgaggtgcaggggagggtcattgtcagttaatcacatgaaagctcaccagggcacactgcattttaacaaccccgtttttaaattttatttccacacaaacacatcagatacctttaaagttagacacatctaacatttgtggaacttaggatgccagggcttttcatctgaatttctggggtgcatttacagcttttctcctaaacatcacgcgtcccattctggcctcctgaagggcggtgcctgctcccgggctgccccctgccataccccgcaaacccccgccaccccctgcaaacgcccaccaccccccacccctcaccaccccccgcaaacccccgcaaacccccgccaccccctgcaaacgcccaccaccccccacccccccacccctcaccaccccctgcaaacccccacccccccccgcaaacccccgccaccctctgcaaacccccgccaccccctgcaaacgcccaccaccccccacccctcaccaccccctgcaaacccccgccaccacgcgcacatcgctgttgatcattgctgcctccacgcgcgccgacatccattcaaacagcaattgctggtgttttctcctctgtgggatgtgccagtaagaatgacctggaagctcccagacatacgtagcaggctcaacgtggcgggggagttggaaggaaaaatggaatccacaactgctgcgcacaggagggaaatgaacccagtgcccgcaggaggcgctgacggcgttccctaaaaacaccgagcaggcaaatgagtgcggactaagcgcccggggaagacggggaagacggggccaggctcgggctccggggattcgtaggatctccagaggggatcatttgtagttaaggatctaatattgccacattctcaatggttttctgttctgcagttctttagagcactgagttttaaaccatgggctgcaactcattaatgacccgtgaattcaagttactggtcactgccagcaaatttttaaatggaaacaaaaatacaacagagaagtatagactaggccgggcacggtggctcacgcctgtaatctcagcactttgggaggccgaggcgggcggatcacgaggtcaggagatcgagaccatcctgcctaaagctgtaaaaccccgtctctactaaaatacaaaatattagccgggcatggtggcgggcgcctgtaatcccagctactcgagaggctgaggcggaagaattgcttgaaccccggaggcagagattgcagtgagctgatattacgcctctgtgctccggcctggcaacagagcaagactccgtccaaaaaaaaaaaaaaaaccgtatagactagaaaataccaaagtacactctggataataagagcacatgtctaatgaaacattttttgggtgtgtgcgtgtgggtgtgtgtgttaggttctgatgtaaaatatacgtcttattgtggaatataatccaaaaagtttgaaagcccttggcaggagcaataccttgcagccatcagggtggtgcagagaaaggaagtcgcttttgtgctgtctcggtgtttgaaacaggaagcagtgcgtgtcgtgggttctcagaggcaggttctgcaggcaaagcctccgcacatacactggaacttgagcaattcacccacctctcctgttcttctcattctttgtttgttaacaaaaagagaagggatcgtaaccttcctacctcgttggaattttaagataattaaatatggtaatataagaccttagagcaaggtgtggctcacagcaagtgttcaatgtcagtttttaccatgattagtatcattgtcatcattgctcatacgctgtgaccaggtaacccagcatcacctgtccaggtttaaaggtgcattcaggaggtttcaggagtgcagctctggaggacgcggccgcggagaggagtcggtgtaatactccagacagatgtccacgttaacttcatgtgtttcccgaacatgatttccatgacaactaatttatttgcatattgcagtaactgaaaacacagacttctgtaattttagattctgaagagttttttgtaaggatttgcccctttaactgcctgtaaattacaagcacgctcccgtgcaaatgggcattcgaaaaggagtcggaatttgtccctgggaggtatttgtgatttagatggaaaattaaatagaaacaggctggctttccctggacaacagcgataacttgctgatgtgtttggaggtcagcctgtggctgtgaagtgtggcttccaggctcataggaagtgaaggtccgctgtcgggaccttgccagcctcgttgccccagatgtcaggcttccagaggaactctgcagtgcgtgacgaacgtattgttgcatcctctgaagagctgagaaacgtcatcagtttgtgatgcctgggccactccgtgaaagtgctgtcaaggatgggaaggtccagttttgtggcaggtccaagggttgaacacgacgaaggagggacaaggaaaggaactgcctcccacctgtcactctgcgtgggctccctgcgttctggtgccttggtcaatatgcttaacgccacagcaaacatgaaggtcacaggacgcgcattctcattctgcaggtgaggaaactgaggcacagagagagtggtgacttctccaaggtcattagtgaatgagtggccagtctaggtctgaaccaagccaaaccctgtaggaccttttgagtatccacactgcttccccaaggaaactaaaatattatatgtccaagtccaggaggtccactcaacaaataaaaggcaaaccttgcatttgacacctgaaactgaggtcggtgttacataattaataaggaattgtgtttggagtaaacctagaaggaacttgcacataagataatttgctcaatcaatctggcacatctccctttgctaatgagttaggcttctccagataaatctgtgagaatgttccattttctcaaacagtatttgttctccccagggcatcagttagttcagcttgaaacctttcttataatacaagcatcgtcattttcaccacactgtggaaccgaaaataaatttccctagtgggtgaccatcctccatggatgtaagggctgtctagtgtaggacaatcaatagatgaccatcttccatggacgtaagtgctgtctagtgtaagacagtcaatagatgaccatcttccatggacgtaagggctgtctagtgtaggacaatcagtagatgaccatctaccatggacgtaagggctgtctagtgtaggacaatcagtagatgaccatcttccatggacgtaagggctgtctagtgtaggacaatcagtagatgaccatcttccatggtcgtaagggctgtctagtgtaggacaatcagtagatgaccatcttccatggacgtaagggctgtctagtgtaggacaatcaatagatgaccatcttccatgggcgtaagtgctgtctagtgtaagacagtcaatagatgaccatcttccatggacgtaagtgctgtctagtgtaagacagtcaatagatgaccatcttccatggacgtaaggtctgtctagtgtaggacaatcagtagatgaccatcttccatggacgtaagggctgtctagtgtaggacaatcaatagatgaccatcttccatggacgtaagtgctgtctagtgtaagacaatcaatagatgaccatcttccatggacgtaaggtctgtctagtgtaggacaatcagtagatgaccatcttccatagacgtaagggctgtctagtgtaagacaatcagtaggtcacatgagcaaaggtgaaccccaaaatctgtttaggaattggaaagagaaacattaggctccaagtcttatcagagcctgacaaaaagcgtgcgtgttttatgtgcactttctaccaccactcgggtttggtattggatgaatactagctgcagttagcagtaattacacatctgactaacaatcttcagaagtctccctgagaacggtgttcctcagccctgtgacgcatcagcccaggtaggcagggctgagggccgacggcctccctaacgcgtctggtccacagttcagtgggagaagccctgctgggaacagctgggttagagtgcactcacgttgcagaaagcctgttgctagcaaacagatgtccattgtagaagaatgtgtgctcctccccataaatttcaaagaaacaaatgtcccataaacttaaaaataacccatgaatgttattacacttaccttgacaacatgatcaaagttgtttatttcacacggtttcataagcagaaatcgccagctagtgatcacggttcagacaaatggtggaaatcgtcggcggcatagggacggggccagcgtgggtgtcagccgtgggtgtggcagttccgcactgacctcggtgcattcctgctctggagtctagcatgggaaaatcacagcccagaagaccctcgggttgcacgtgtgactgacgcactcccccgagagaggccaacacctcacagcagcctgccgcagcagcgaaatgcctgcactgaggctgtctgttaaaagcaaacaacatggcagttgttttagccaagcacgcttcttgctgagaattctaggaggttcagctgacagcaaatgcgtgagtaccccagctcgctgtgtccatggagtagagatctcagacttcgcagctttgacttatcaatctaaaggttaattagacaaactgggtgactactgccaacattttctaaagacaggtcacactctaggtttctaatttgtcttccgaatgaccctgatcctggaaagtgaggccccgggtcatggtcgcaccgccaccctgtgccatctgtgtgtgcacgttggtgtcccaggccacagcggagaaagatgggagaggccacaggccaggccctgggaggatcagtgggataagcatctgcctttcccagtgcagaggaggatggaagaggccacaggccagctccagggaggctcagtgggataagcatctgcctttcccagtgcagggcaagacgggagaggccacaggccagctccagggaggctcggtgggataagcgtctgcctttcccagtgcaagggaggacggaagaggccacaggccagctccagggaggctcagtgggataagcatctgcctttcccagtgcagggcaagacgagagaggccacaggccagctccagggaggctcggtgggataagcgtctgcctttcccagtgcaagggaggacgggagaggccacaggccagctccagggaggctcggtgggatacgctactgcctttcccagtgcagaggaggaagggagaggccacaggccagccccacggaggctcggtgggatacacgtccgcctttccctgggaacagctggtgggagcggtgcaagcacagcccagctcagaggggccgtcacccccatcagtggcaagtggtttgcctctgtggcatagcacctgcccatctcccagagacaatactgcctggaaaattgcagcattgaatttctaacctaaaaattgaggtgagaccttgctaagccctcctggtcgtgtatgtaagctcgttgggaactgcagcttttctcagtaaaagcttcctaatcatatgcaattccctaaaagtacactttttaataaacaattatagatgtgtaagttacaaaaataatacagagaaatcctgggcacccttcccccagtttcacccatggtcacgttcgtacagtccaaggtccaacacgaaacatccttcttccagacaatggcggtcgaacctcagacccatccttgccttccttccctccttcattcatccatccatttcagcatttactgaaaccctgctgcctacgcaatgtgattgagatgttgaactgaaaggtaccaggagctcacacatcccctccccttcccgggttatcttacgtgatatggggcacagatttgctttaaataatttacttctgagcgcccaccactctggagaagagctaggcaggcattgggtggcgtcttgtggccacacgagcagccccaggtgaagcaaagcctgcacccaattagacatctaggaattcacagtgacgggaaagaggaattgtacataattagagatatgttttctctccagtacaaatgtcctctttctgcctgaatttaaatgcaactctcattttttcttatgcgactattcccagaaggcttcccgcatcctgcgaagcgaagggtaacccccaacagcccaggtgttttcaatggcacacatggttcctgctttctgtttcacataacacagaaccccagagcacgttttaagctccacttttaaaacttaatgaaattgtataaaattcagctactgtatcaaggaacagcgagaaaatattgtgttggagaatataaaaggaaataatatgaatagcgttaatatttcagtaagagctacacatgtggtcaggagtgtgaaacttctatcagccatttatgggtgtttctcacctccaggcgccgctagagaactttgcttatactcacctatgtcactcatcccttcacagctgtgtggcctctctgctgtcaccccattctaaaggaggggacagcacgtgacagaacgagtcccacagtcagtgaggatgggcacacgctgcaggtggaggcccaagctcctagtccatgtagctgctgcatctctcagcaggacaggaaaggaaggccggcctgagtccggagggtggcgctcagcgtgatgccacccagagtctgacagagctgcatggcaggaccccggggagatgaaagccagccccacgaggggaagagcccctacaagagcacagccagcgggcaggagcacgcagggagaccgacgtgcagggacaccaacgtgtagagagactgacgtggagggagaccgacatggagggagaccgacgtgcagggagaccaacgtgcagggataccgatccctgcagggagaccaacatgcagaaaacgcatgtttggcctgaaatgggatggatgcatccaaccaaagagaaaacaaggaaggaggagacatggaaggcagccttggaaatcacggagagttgttgcattgattcttttgcagccgatgagcacacccaccctgcacttgagtttcagggccaaggtgtctttctttcttttgaagggaaaaaggacctgggccagagaaaccatcatggaggcatcctgggaggggcacagagaaaaggagtcctctcccttcccttaagacagacagggcagtcagcatacacatgcacatacatgaacacacaggcatgcacacagatgtgcacacacacacgcagacacatgcacacacacgtgcagacatgaaaacaattgtagacatgcaaaaatatgcagacagaaatgtgcacacacacacacaggtgcatgcacatgcagacacacatgcagatgcacacaaacacgagcagacatgaaaatacaattgcagacatgcaaaaatatgcagacacacgtgcatgcacacacacatgcagacacaagcacacacacatgcagacatgaaatatacacatacacatgttgacacacacaacatgcacaaatatgcagacacacaaacacatgcacagataggcacactcacacacttgtatgcacacacatgcacaaacatacaacacatacaacacacctgacctgtctgcccctccagtctgttccctgctcccattccctctgtactgtgctatggactctttaattcctttcccttttcctccacatctcacagagggatgggcttattacaatgtgcagttcccttaatggatgagtgagtgaatgagtgcaggagggaatgatcgagtgagtgaatgactggatgagtgactgagttactgagtgagaatgagtgagtgagtgcatgaatgagtgagtgaatgagtaactgagtgaatgagtgagtgggtgagtaaaaaagtacatgaatgagtgcatgaatgagtgactgagtgaatgagtgactgagtgaggaaaggaaagagggagggaatgagtgagtgagtgattggatgagtgaccaagtgagttactgagtgagaatgagtgaatgtgtgcatgaatgagtgagtgaatgagtgagttactgagtaaatgagtgagtgaaagagcacacaaatgagtgactgaatgagtgcatgaatgagtgagtgaatgagggagggagggagtgaatgagttcatgaatgagtgagtgaataagggagggagtgaatgagtgagtgagtgactgagtgaatgagtgggtgactgagtgaaagagtgagtgactgaatgagtgggtgactgagggaaagagtgactgagtgaatgagtgggtgactgagtgaaagagtacatgaatgagtgagtgaatgagttcatgaatcagtcagtgagtgagtgagtgcatgaatgagtgagtgaatgagggagggagggcgtgaatgagtgagtgaatgagtgcatgaatgagtgagtgaatcagggagggaaggagtgaatgagtgagtgagtgactgagtgaatgagtgggtgactgagtgaaagagtgagtgactgagtgaatgagtgggtgactgagtgaaagagtgagtgactgagaaaatgagtgggtgactgagtgaaagagtacacgaatgagtgagtgaatcagtgagtgagtgagtgcatgaatgagtgaaaggcacaatcaggcttgtgcctttttttgtgctgaaattagttttaagcaggtgaaactccctacagcttcaagaggatgaggagatatgttttgttctgtttgcttgaaacaataaaatacataaaaaatgaagcacctcatccactgtctcaggcagcgagagcctgccagtccccaacagccccagggtgcagaggtgaggaaggctttctcacctccgcggtcaccaggaatcgaggttcagtagaatcaccccatcttgaaggccgcagcctcaaggtccaagtcttcattccccaggttgaagacatgagctggggacccccatggctgtgggtggagggcgagtcctggacgtagtgcttcattctgtcttttgaaaggggtgatgttagaaagtgagttctggcagctgtggggaggaagaagtcaagccctctgtggggtcaggagcttggaaaaaggaccctgaagagttagacctggagtggccagacctaggcagggatggaagaacggatgtggagcccaggaggagcagagagcacgccatgagggaggggccgtggtgaggggcacccctgggcgcccagtgcttggtcctgcaacaccttacgtctcagggcgtttccccaccccctgctccactgagagcctcccaccctggcctcgtttcctccaccgagctgtgcatcctcagggagagagagcagaagagccgctcctctttggaaaactgagaagctctcctccgagtcagtgctctccccatccaccagcaaggggcccctccatccgaatgcaggcacacacctgctaaaatgcaccacacagcagaagggcctcccgtttctggctaggagagccctgcctgtggcaggcagcagcatttgcaagcctctctgcagttacgcttggagttttggtgtggtggaaataggcaagaagtcgatgtccagctgcttgttggattagggatcacaaatgtgtgtttattttccaaaaacaagacattggcatgatagtgtggccctgggggcagggtcatggaataagacagagactggggagccttgcacaaaataaccatcccccacggtatgttgtttggacctgggaactttctggagcaagtgctcatcgtcagtaacacacactaactgaatttcactcaaggcagatttgtggactattttgttgaaatgacatctgtagaaaaatttaaaagtgattaaaactgatggctgctgccggatgatggagtctggtgcatctcagacagcccttatttggaacagtctgtgggcatgtctaggttattgagtgttacgcttctgtgttatgtgacttgtccgtaccatttagcctcccaattggacacggaatcgagtttgctagcgttcagccctaactggaatggcgactgctcccaaattgcattctggccctaatgaaatctgtctgcttcatcctcatctgccaggacacagcacattagctcttatgggttttgttgtttgtttttgtcttcagattgtcggttctgtggctgtggcaaaccgagtggaggtttaagatggacttttaaatacaaattatgaagggaaaaagcaagtcacttcatgtatgcttgtgcatttacaaggcacatagaacaaagctgacatttatataacgtttgagtttcataagagcatggctgtggtgactgtccagtttttagatgaagaaattgagtctcatccaaccttgatcagctaataaatgaccacgtggtgatttcggcccagacacccttatgttcctagtagacttgagctcaagtcatataaatttggttctccctgccatggacaatggttcttgagtaaattatggagtctttgagatttgtttttctcaggctccaaatattgtgataatatataaattgtacagtgattctgcaaaccatatcgaacccatgttagatatttgcattctagtcactgtctttggctactggaaatgattgtatgtgtgtgcacatcagcattcagtggatactgagcggcatctggatatttagtaaaacacattctcacgccagtgcccgtgcttctccctctgcgtggctaagatgagaccaactctgcttggagggtcctgtccatcccaggccctcccgaccgtgtgtcctccagctaattccgaaattttgagtgccaggatctcaacaacgagccacagataggagcctgtggtccctgccgtgaaggagctggcagtccaggaagggatacgaaggcttggctttcacatgtgatgtgctaaggtgtcagaagggaagaatatttcagctgcaattgggaagaaacagaaggggcttctggaaaatgagcaacgctgtcctggaaagtgaagaacaccaaagttagctcagctttacgcagcggcatgtcccatcctacgcctgaaaaccaaaaagcatagaacccttgtctacttggaaatcttaaaaaaaaaatctaaacatgtgctttgtgtgccaaacagtagctccaggttcactgactgcccgaaattcagtgttttgcacgacaagttcattaacctgctgctgaaagggcctttgcaattcaaggttggatccatcagaaaatagaatatgaaactgataaagctctcttttcaagtcaatactttatttcctctccaggaagagactttcgttagagaggcacaagctgcattctctgaccctgatccccttgtttaacggttctgacgaccctgagcctggctctccccatgcaccttccccatggacaccacctcttgcctaaactagattaaatgttccagaccccagaagaaaagtccagaactcattgtgggcctgggatccgtatgcacttgcctgcctgtaagaagccagcctgcgggcctggcccagctgggatgtcagcatcctggggacctggccctgtgctgcctgtcacagtgggttttgtgctcagcaggtgatggccccggcagggccgcccatggcttcctttgggggcacagagcaggggagcatgggtggggtggggatcctagaccaaaggggcgtggctgggtttgggtctatcctcccacacctgccctgggagcctcggtttccagtctgcaggaggaggaggagctcccagctgcttcgcaggagcaggaggtgtgggccatcgctgttggctgcatgtgaaggaggggccttctccactgagagctctctctgcccctggagtgctgggcacgctgtccccatctctgcttcccaacataccatgggctatacacctgatgaacatgttagtgattatctgacgagatcaatggttcatcagctatcgatggggtgtccacaatggctgaggagaagaacagctgcaggcccccaccccggagctcatggttcacagagggaagaagatgggaaaacgctggggcacacggaggggagcgatgcaatcggggaacccagaaagtatttggggagcaggaggaggttcactccgagtggtttcccgtgttcttcacccctcgcactggcgtggtgcatctgtcacaattgatgagccaggattgatgtgttagtgactaaagccatccttcatccttcacgtcaggggtcacgcttggcatggtccaccctgtgggtttggacgagtgtttaatggtgtggactccccactgccacctcacacagagcagtttccttgccctaaaaatcctgcgtgctccccctattcatccctccctgcccccaacccctggcaaacactgactctttcgctacctttgtagttctgccttttccagaatgacccatggattcaaagagtgtgaaggctttttcatggcttgggagctcatttcattttagcactgaataatattccactgcctgatgtaacggtttactcacctcctgaaggacatcttccaagtttgggcaattgtgaataatgttgctatacacatctgtgtgcgggttgatgtgtggatgtaagttttgagcttctttgggtgaatacctgggggcgtgattgctggactgcatggtgagtgcctagttttgtaagaaaccacgaaactgtcttccaaagtggctgcaccgctttgcactcccacgggtaatgaaagagttcctgaggctccgcgtcctggccggcgtgtggtactgttggggtctggattctggccgttctattcggggtgtggtggtgtcttgttgttgttttaatttggaatactcgggcgggaggtgatatggggcgtctggtttgcacacttgttttaatttggaatacttgggcggcaggtgatatggggcatctggtttgcacacttgttttaatttggaatactcgggggcaggtgatatggggcatctctggtttgcacacttgttttaatttggaatacttgggggcaggtgatatggggcatctctggtttgcacacttgttttaatttggaatactcgggcggcaggtgatatggggcatctggtttgcacacttgttttaatttggaatactcgggggcaggtgatatggagcgtctctggtttgcacacttgttttaatttggaatactcgggcggcaggtgatatggggcatctctggtttgcacacttgttttaatttggaatactcgggcggcaggtgatatggggcatctggtttgcacacttgttttaatttggaatactcgggggcagctgatatggggcgtctctggtttgcacacttgttttaatttggaatactcgggcggcaggtgatatggggcatctggtttgcacacttgttttaatttggaatactcgggcggcaggtgatatggggcatctggtttgcacacttgttttaatttggaatactcgggggcagctgatatggggcgtctctggtttgcacacttgttttaatttggaatactcgggcggcaggtgatatggggcatctggtttgcacacttgttttaatttggaatactcgggggcaggtgatttggggcgtctctggtttgcacacttgttttaatttggaatactcgggtggcaggtgatatggggcatctggtttgcacacttgttttaatttggaatactcggcagctgatatggggcgtctctggtttgcacacttgttttaatttggaatactcgggggcaggtgatttggggcgtctctggtttgcacacttgttttaatttggaatactcgggggcaggtgatttggggtgtctctggtttgcacacttgttttaatttggaatcctcgggtggcacgtggtgtggagcatctttggtttccacgcttggcatctgagtgtcctcttcggtggggtccactcagacctttcgcccatttttcccagttgggtttgatgcaccagcatcctgccgtataacagtctggttctgatgcttgttctgtttcttcaagctgtgtcttctgtgttgaaatatgccttgtggtagttttgctgaaagccgaaacagctgagtgcatggggaagctggcaggtgtgcagcagccggggcccagggcatcacacccacaggggcctgggggacctccttttgctcagagcacgggatccacagtgctggggccaaggccagtcagagcctcacgcacgggtgctgggtcatcaccatgcccgggaagctgggcccccggccatcagcagatcctttacttccttacgtcttggttttctcctcagtgaagcaggacgcacaggtttcctcatgtggccattgcaaggatttaaggggacgcctgtaaagtcaccagcagaacctgggagctgagtggaggagcttctttttcagcagaaagagggagaatgagttttcaggatcaggagacggcagtgacctgctgtgtaaactttcaaattacacgcgccaagtggttctaaataaatgaatcaggttaattagcaaacaacagccatttattctctttaatagcctcatgggatatcaagaggctattatatgatatgatatcatgcattttggcatgaaaattagggagtagctctacattgctaaagggatgcagctttttacctgggtgacagatgtatatgttttaaagtaacttaaatgcattaccctttgctcttcacgtcagccacataaactaaggaccaggggcagctggagactcactggtcagaaccagcagcactggggtcacacccaggctgggaacctgcagacggcactgcccgtgcggcatctcctgggacctgggagctttcacgccacgcgtatgataagttctggggggcgggagtgaggaaaaggcccccctctggtggtccgggcccatggtcctgccaggggcccacagcatgaagatgtagctccctcacacacacgttgaatttggatttgcttgtctggcttctgctggggcgcaggatgtggggatggaaggaccaagacacacgacagagaacagcgtcacggggtcaccgtcccacttcccaccccgcgcctcacagcacagacgggggatttgccggcctcacgccggccgagccactgctgacttcacgcagccccagccatgcccccacgcagacacacggagccccaaggcgggccagatctcagggccggatggggctgtggagctgtgccttagacgggggggaaggactccctgccccaggccggcaccgcacagtccctgggtagaaaattgagtcctgtttggaggacagctgctcccacatctgggggcctctggatctgcagggcagggctttggtggtccataaacataccccgaggaacactcgtggagccgtctgcattttatttttgtcaattatggcactaatcatgtccttttactagagatcccgcagtgtctgtgctccttcgttacatccctaaaagacaagctcccgagggccatccatggtggcctcccagcagttcctgcacgtcacagcatttaaaagaaatccagtgaataaaacagttcagcttcaattcagtaaccgcatagaatttcacttgtgaattgaaaagttcagggcctgagataatcttaagctgctggatctgtggggaaaacaaacatctgaggtccagaattcgtttggagactccgccgcaagtccggattcggcatcagatcagctgtgctgtgtgtgcttccaaagacgtttctgatctgcagggacgtcgtcccgtgtaagagttcagcggtgcctccactctggacggcagaactgatccccagacggggctggccttgtctttcaagcagagaccagagtgggcttttaaaggggaacatcttcagggtgtgcgtcggggtcagcctcatgttcccagagcccatctgagaggccggcagggaggaagggaccctgttccttgctgtctgttgtccaccaatctccttagaaggttgtctctttaggggacaacacagaccctcaccggtgctgactgggaggaaggagcctggctacccccagctgtgcttccaagcagtgtgagtcacatttagcgttgtttgcagaactgaaatgctccctgtagagtcagcttgggcagccctaactaaggagcccagactgggcggcttaaacaacggacgttgattctcccatgtcctggaggctgcagttcaagaccaaggtatggcagagctgaatcctgctgaggcccctctccctggcatgcaaaccccatcttctccttgtgtcctcacagcgtcatccctccgtgcgtttttgtgtccccatatcatcttctcaaaaaaatagatcctggagctctttccatataatcacataaaaaaccttctcattgcctttccaagggtacaagtgacgtcacacagtgagagggacacagtcatcggaccagcttacagtcttcccaccgccttgccacagacctgggctttctgtgaacatctcaggtccttccgtctgcatcactcttaccacccgtgggttcatcatcttcccacatgatcctgggaccttttagcgctgtgttctgctaaccctcctgcacacccttggccatttgtccccggttatttgttggtatttttcttcttgacttcttggtggttttgcggggagattgtccttttgtggatggcggagcagccaatcctttccctggctttcatttgcctttactttgcttccattgttttctttctgttcagaagtgctgagtgtgctcaaattccttggtcctttttgtacagcttctggattttcagctgttgttaggtctcctgaggcaacaacttcaaagcaattcaccggtgtgtctctaggactctgatgtcttttttttttttttttttttttgatatatgacattgttgaaacttttggggagcaaacttaccttaaagtcatgagttcaaaattcaaaccaggcttctgacaagttactaccactatgtattatctaatgtttagtttttggttaatggctttttattttagttggatttttctgaatgaaattgattgctgttagctggtggaattacaggagcattttccatccattttttctgagctgcgcagttattgatggtgaccatcagagtcccagtgtacaatcctggcgatggcagaacagggaggtgggcagaccccaaagctgcggtcctcagaaaatggaagaactcaggacttacacagcagaagctccacacttctaaagatttagtgaattcccagatccaaccatgtgcgaatcgcagaaagaatagtagatttaaaaagtcaccttgagattctaatgctgggaggttcttcctgatctcacctctgcttatacagtgtatcctcactcccagcctcttagcaaaatgccccaaatcacctgtgtggtgttgggcagtgatggagcctaggtgtatcttggcctcatctcttgtgtgacattgggtagtgacgggacctcagcatgtcttggcctcatctcctgtgtgacgttgggcggtgatgggaccttggtgtgtcttggctttgtctgtaaagtggatttatgctgcaggctaagtatccctcttctgaaatgcttggcattagacgtgtttcagatttggaatttttttggaatgggggacatttgcattacatacttgccaagtgaacatccctaatccaaaactctgaactccaaagcgctccagtgagcatttcctctgagcgtcaccgtggcagccagtaagtttcagatttgggagtaacaatgtaatgacaatgctgtgagcgcttctcagttcccatggtgttcccaacgggcttcagttcctgaacgctgttccctcctctgctggagcctcctgcattgactccccaggtggacgttgcggtggcgattgtgtttttacactcacgggtccatagccctgctctgtgacagcgcctcacctgcgttaaccttcctacctcttacctgcacgcctaccggcagggctgagagtctcccccactcacaggggaggaattgggggctcagagggtgggaatgcatgtgggtccaagggcagtcagtggtggagctggatttagactcattcaacttagactccggagcccaggaccataatcatgggcagtgctgcctctttattttggaagcagatgatgaaacacctgaattacaatcatttgaacaagcaaagctggtttgttctcatagcgagacttcccgaggaggacggtggtgagtcctggctgaccgctgagttctgccactgaagacaaaggctttcttcatcttttcactctgccatccttattgggttgactttaagtcctcttggttgcaaggaggttgccaggtatccagccactaactccacatcaagagaggaaggagggagctgcagtggtgtgagctacgtctatccctgttattggaaacccagagcttcccagagactcccctacgtgacttccatttacctctcaggcccagggttctctctgggcagccctcctgcagcagagcctggaaagggggcggtggctttgccaccttggagaggagagggcagggcaagagcaaaggaaacgtggtgtggcctcgagttaggctgcaagcagcgggtgccgtcacaagcccacccgttaccacgacttcgcatcgtctacattgcaggctcacgttcacatgccctatccaaccctctcctgcgagcagcgggtgccatcacaagcccacccgttaccacagcttcacatcgtctacaccgcgggctcacgttcacacgccctatccaaccctctcctgtgagttcacaaatccgtgactgacatggtgtgcacctcgtcctcttgtccaggcttctcacaaacaaaatgtcccaccccagctttcaagtctcaccagagcctttgctgccccatgcctgagtgacaccaccatccacccggctccagccagaggcccttgcccactgatcccctccgggaggggccacctggcacatctctgagtcaagtcaccgtcacaggcaagctcccgcttctcacgtgcaggacagatggcgccaggaagaggatgtcagtggaaagccataataagttcaaacatgaaattagtgtctcacacagcagctctggtctttgtcagactttaattgggatcagcacagattcattgccatggagagggaagtaaaatgggtaaattccagtgcatttctgagagtgagaaaagtttctatttttcctaaggaaagaagagaactgaaatacgcttccttttataacctatctatgtgggaacggaacggaaatattcagaatgtaaaacactcctgcctgtgtctatgcagcatgcacggcgtaactggggctggcacgaggggtcaaggacaagcaggactctacctgccacccccctcagggggacacagtgcacgcgtttagcatctcccaggacatgtgctacctgaagcccaagggaaagtccacccatttttaatattttctgtttgaaaaaaaaaatacacagctcatctttatgttcaactatgcttttaagtatctgcaaaaaaaaaaaagttcattcaactgattgtattacatacaattttcatggacattttttgtacagttatgacacttcagctaaaagaaaaaagtccttactgaaagaggcttaaaatacagaaagctttgcctctcctggaggaaccatcaataacgtggcttccagccactgcacggcagtgactgctgtgcggtccaggcctccaccccgtcggacgcagcgatacctttgaaaacagcacctcctcctgggttactgggttccactgctggaacagctgccccgaggctttctagctttcctcctcaggccactggccaggtctaggcccaagcaggagcccaccccaggcaggaggacaagtatcccaggaggacctgagcccacgaacactcctggctcactgcccaggcctggagtgaacagggcattgttcccaccccagtgccagggatgagggcagaggaagaaagtaaagcaaaacagaagacgtcataaactcctaagcccagagcactgggagatctcacatctatgaaaacttctcaaagggcggtgcctccaccaggagcagcagcagctaggaacttgacagaaatgtagattctcagggcccacccgggggctggcctgcgataccccaggtgattctcatgctgagaataaatgtgatgctggctctgtctcctgtcaccaccttccgcctggagcctcttgtcctcagtcaacatggctttgccattgcagctgtagggacaggtgagtgggtgaccagatgaccgagctgaaacaggccctggcagtaaggagcctggccttcctgtttggaaacaggaggatgagccaaggaggagacacaggaaaggaatgtcctgccatcttaaggaaggactgggagctccccttttacagaaagcaaacaaatgcttgatttcctaggtgcttccaggcagaaaatagtgatgctcaggaaacagtaaaagcctttctgcaatttttaaaaatcagttctttcctcacttattgattcctagcatttcctaaaatgttcacgtgatatttaaccttcctcatgtttataaaattatagtggctaaaaatccttctgtattagtctgttgtcctactgctttatataaagagctgcctgagactgggtaatttataaaggaaagaggtttaattgactcacagttcagcatggctggtgaggcctcaggaaacttacaatcgtggcggaaggtgaaggggaagcaaggcacctacttcacaaggtagcaggaaggagaaggggaagagccccttgtaaaaccatcagatcttgtgagatctcactcactatcatgagaacagcatgggggatacagcccccaggattcaatgacctccacttggtctctcccttgaaacatggggattatagggattgtcattgaagatgagatttagatggagacacaaagcctggccatatcaccttcttatgatgtctttcatgccacagattatctcagtggtggccaacaagatggaccgaagacttcagaagcaacaggagagctgagggttggagtgttcatcatatgctgagaaaaattcatgtttatagaaagcaccaaaaatattaattacccaaagagagtgagtcaccaggtgctgtcaaacccaaggcagggactcgagttgccaaaaattccagacaactgctgatatggtgaacattaaaaaattacagaagttaagcttgaacaatgtgaaaaaatggcaaataattactctttgaacagacacttatcagggaacctgccccgatattcacgtaggttcttttctattttccttaagcgttggccagcttgagaaataaagggacagactacaaaagagagaaattttaaagctgggcatccggggagacatcacatgtcggtacgttccatgatgccccacaagccacaaaaaccagcacgtttttattagggagtttcaaaaggggagggagtgtgcgaataggtgtgggtcacagacatcaagtactttacaaggtaatagaataccacaaggcaagtggaggcagggtgagatcacaggaccacaggacgggagcgaaattaaaattgctaatgaagtttcgggcaccactgtcattgataacatcttatcaggagacagggttttgagatcaaccggtctgatcaaaatttatttggcaggaatttcctcttcctaataagcctgggagcactatgggagactggggtctatttcacccctacagtctcaaccacaggagacaggtgcacctgggggggctgtttataagcctatacctccaggcacgtattctctttcccagggatgttccatgctgagaaaaagaattcagcgatatttctcccatttgcttttgaaagaagagaaatatggctctgttctgcccagctcaccggtggtcagagtttaaggttatctctcttattccctgaacaattgctgttatcctgttcttttttcagggtgcccacatttcatattgctcaaacacacatgctgtacaatttgtgcagttaatgcaattattacagggtcctgaggcgacatacattctcctcagctgacaggattaagagattaaagtaaagacaggcataggaaatcacaagggtactgaatggggaagtgataagtgtccatgaaatctttacagtttatgtttagagactgcagtaaagacaggcataagaaattacaaaagtattaatttggggaactaataaatgtccatgaaatcttcacaatccacgttcttctgccatggcttcagccagtccctccgtctggggtccctgacttcctgcaacagacactcaaattgttgtggtgattataacaattccacgtgcataccttccccacttccagcagaggtaggtgaagacttggggtcagaagagactgtttcctatgtgtgaatatcagccagtggtgtgatctggtctatcaggaattcagtaggctgaaattccaactgtaaagaacatttttggattccatatataaatggttaggtacaaaaatttgttttctaacattcctcactttgaaagttcattccaatgttttctgtttaataaatattgagaaaccataaagtttccaaatgtattccacattcccttgaaagtgctgaaactttgtttcttttttaagtttatttttgaagcaacttaagttcctcccctccccgctaaaaaagcaggcaactggttaagtatggtgcattaattaaatagtaagatattattagagagcgtgtgcgtgtgtgtgtgtgtgtgtgtgtgtgtgtgtgttcaggttcttaacctgggacaaatttcataagagataataatgagataaggaaaagcttctttctgtattctcctagaataagtttccaggtcaaattacttgctaaaaggacctgtatttcaaaagctgttttcttcatttagttcagtggtttgactgttagtgaggttagaatttttttcagctatttggtattaatttgtattttcatgtctatgaaattatttcatactgataattttttgaaggaaatgttttcttatttacaggaatcttttaaatattaagtatgttattgcactccagcctgggcaacaagaatgaaactctgtctcaaaataaagtagatatattagtgtttaggatgtatatttccttttttatattttaatattctctaagaggaaaattctcttttgattttgaaatgtatttttctgaccaactcgtgtggtcttggtgtgtgcataactaaattttgtttctctccttgcattgactggcagaaagttagagctacatgtaaatcatgcccatagctaactgtgaaccctgaacatttgagacaggtctcagtttatttagaaagtttattttgccaaggttgtcacgcacacccgtgacacagcctcaagaggtcctgaggacatgtgcccaaggtggttggggcgcagcttggttttacacattttagggagacatgagacattaatatacgtaagaagtacactggttccgtccagagggggttccaggtcataggaaggtgagagacacatggttgcattcttttgagtttctgataagccctttgaaggagacagtcagcatatgcatctgtctcagtgagcagagggatgactttgaatagagtgggaggcaggtttgccctgagcagttcccagcctgatttttccctttagcttagtgatattggggcccaaaggttttcctctcacataacatgggggaggtcctggaacgcactctttgtggaaacctccttcccatgccactgccattccgatccttctctctcttgcttcatatctaaatgctttataaatttacctgactttctcatttgtatttgcaaatcaaattagctcctttttagaatgtgtcagggagtaagtaaataagcaatacgagattggttttctgatacagaaacatccttctgcagtgtctttgtttaagagtattttcatatggaatactataattacctacccaaaggatggaaacatttttatggctcttaagatttgggtcaatttatttctcagaaggtcacactaactgataaatgccctcaaataatcaattcttgctttactgcatcctaatcataacagtatattttaatttttaatgtatgtatttgattcaaagaaatgtgcaaaaacttttaatttaatttacaatagagttactttttaaaataggtagaaaggaaagatcgggtttgtgaaaatactctttctctgctttctactgacgtcagttaggaggttcggttatagtcaaatgttttgaaacaattttaaggaattgaactcacaaaaaggctcttcctaggagaggaatacaagtccagcctaactttttaaagtcctcatgagcgtggctgcctttccacctgccgagcaccacgtatgccccacggtgaaatcacacctttgttgggctctgagatgcattcacctgcacttctgtctactctccttgcatataaattatttccagatgattctttcaaaatcataggcctgatttatagattcccaaatgagatattctcccccgaagaaatttgtcatgttaaaaaatgtgcagttgttagtcactgattctagggaaaaaaaaaaaaaaaagattaacggcataaatccatattgatgttgcctatttatcatttgatttttagaatatgtttttcaaccgggcgcagtggctcatgcctgtaattccagcactttgggaggccgaggtgggcagatcatgaggtcaggagatcaagatcatcctggctaacatggtgaaaccccgtctctactaaaaatacaaacaaaaaaaaaattagccgggcgttgtggcgggcacctgtagtccgagctactcggcaggctgaggcaggagaatggtgtgaacctgggaggcagagtttgcagtgagccgagatcgcgccactgcattccagcctgggcgaaagagtgagactctgtctccaaaaaaaaaaagaatgtgtttttcctaaaaatgctgtgtgcactgatggcaataaataaatactgtctgactattttcaggatttaaatttaaattttaaattttaattaaaatttggattttaacttgcaatgtttataccaaaggttctgagtttctgtcatcttaaaacttaaaattaacttaattttcataaaacttcaagttgataaactgagaaggtcatcaatagtaccttaaaaatactgtcaatcagcccaggcaatgtggagagaccctgtctctacaaaaaaattaaaaaatagcctggcacagcggcctgagcctgttgtcccagctcctcaggaggctgaggtgggaggattgcttgagcgggagtttgaggcgacagtgagctatcatcacaccactgcactccagactgggcagcagagcaagactttatctaaaaaaataaaatactatgaatacatatttcaaaattacatttgcttatgaaataattattaaaagtcaaatgttttaaaacaagcattcttcttttgctgtattctgatatatacatttggaaattgtcagcaggttataaatttgtgtcaaagcaaaaatataatcacccaaaaccgtataaaaggtaaaagagaaagattgattggttggtttaaattaaggagcccctgatcttgtttcaaaggaaactcaggaagatatttgggaaacaattataattacttttgtgaagcgaaaagtgtgtgtcacaaggcaaattttctagcacagaaagtaaggtatgaccttttggcttcaggaataatgagattaggtttacaactgatagcagctttcttttgtgctttggaagtcattgttttctaatgttacaataaagatctgttttaaagctacttattttgcctataaataagatgtcatttggtaatcaagggcaattaagttgcaaatgtgctcaccataatgcttaatcgaaaatgtaatgaaattctgaaagagttgaagagttgaacacctgagtttagaatcacaaaactccttatgttcaccttgtaccaatcaaaagacatctatgagcagtttttctttaaaattagaactttgatatatgtggaatcagtggggattttttttaaagatgtttcttaaagatggattttttgtccatctcgctattgaacctgctggtctgagaacctgctggtcaaagattaatcacaaggctgtgtgtgtttgtgtgtgcatgtgtgtgagtgcacgtgtacgtgtgtgagtgtaagtgtgtgtgcgcgtgatgtgtgtgcgtgtgcgcacgtgtgcttgcgtgtgtgtgaaatcagactttgcacgacccactctggaacacattataagagttaatgaaatcctaaatattagctgagattgtgttgaatggatgaaatcttcttggccagctccatttccaaggtggccttttgactccatttgccagagcgcactgttttcgtgtcccaagcgttcatttcattaagctctttctggttgcaaagggcaggcacccggagccaccttctgtagggcaaggtcctgtggagccacgggaggaatcgagggaggcaggccctgtctcagcaagtgctggccgctccccgacagatgcccagaagtccccccaggggtagtggccgcctctgtgaagacactcagagggctgggctgtagccctggtcatcacagcctcagccctggacagctgaattgagcctggcagctgaattgttctccatgttgctgtgagcccactgacaaactcctgccctcagtgtctggatttcacacgccctgagaaagaggatgtgatttatcctctcaatcacccacaaacatgaaatgcgcttgcctggcctcaccccacgatgggtcaggaacgatggccaagagggcaggattttacggggctgagtgtgtcgacacacatgttgttcatgctgtcagatgggcatgcctagcacagacgtgttcaagcggtcagatgggcatgcctggcacacacgttgttgtgaactcttgcattgttggtaagatgtgtgatggatttggttttaccaaaaatggcaaatgtggagttatttttaaggcatacttcgtgtgctatttcttgatgtggttttatcacacagtgttgttttcgtccaccttggtgcaacggccctggtgttgcaagaggaggtgagctctgagcagaattctcacatatctccacttaggacacattgttgagcatcgatgtgtgccagagacttgcagggcattgaaggcagacagtgggctgccctgtgccggctctcaggtcccaagcctggatgactagggcatggacggtgctgtggatggatggtgttggtggtcagccagcacaagcaccacaagcactgctctgacatcccttgcgtggcagacacgttgccatcctctccgaggctcacctgagagtctagtgtgtcggctataatgtaacagtcatgacacgtgagtagcattagccccagtttctccattaaaggaattaaaccgtttgtgacagtcaactcggtgtagcaggacaagcacctagggcaggtgggggcaccctgagtattcaggagaactgttggttgatggagtggaagagacagaagccagggcaccgtggttctggctggaacttgggcacctacaagccatctgaacttgggaaagtcaccttcttggagcagtaatgttgtcatctgccagtcatgggtagtgactgacgacttcccgggattgttagcagaaccacatgaaatcagcaccatgccgacgaccatgaaaactgcctctcatttcatacccgagaaccaatatcttattcattcctaaaaaaggattatctaacatccatggggtcagattagccatacagaggcaggtgcattaaaattctgaattttcaagtgaacgaaaagatcttcctttttccattcggtaaaccagagcaccaccttgatctgaaagcattttgagcctggcgtgatggactttgtgcttctgcgaaagtgtagtataaattccatggggccagccctgcatcctgactgtccccgagggctctctagagaaagatgtcaaggccagccctgtcctcaggtgcagtcagcagactctgaatctgaacccgcgtttggtctcatattcattttgtctcccttttgcccaaagcatcccattccttttctgccacttctctcccaagttttcccacctctttatttttatttccattcaaatatttcactttgacaccattgaactaattcctccctgtaggaggcgctggccaggcccaggaggcgacatgagggcattcagtgctcacagtcgctaatatgtcatctgcttgctgcgggcctggcatggtctaggatgtttacctctgttggctcatttaatgctcaccacgaccctccaaggccggtacaatgattacgggcccttcacacctcggagaagtagtcaggaagtctcccaaggcagcaccactggtatgtggtatgtggtatgtggtatgtggtgtgtggtgtgtggtgtgtggtatgtggtagacccctgcagctctgcagcctggctgtcaagcctctgggttctcctggagcttacgacctaatgggtgtgcatgcatgcatatgtgtgtacaaaagcatgtgcatctgtgtgtttgcgtgtgcgtgcaagtttgtgcatgtgcataatcatgcatgtgtggttacacatgtgcacatagttgtgtgtgcctgtgtgtgtggtgagtgtgtgttggggtggaggtgaacaaggcaggaaaatggggaggccatgacagtttttatgtcattaaaatgattacctatccttgagttccaaatgatatctgccaaacccttccctgattctcccatgcctgccaccaccaccctgccccagtctctcagctgcaccccgtgtacctctctctgtctgcaggaaaaaccccattccaaggactggcttactcacccttttctgctattagactttgaacaccagatcttgcttccgtaggacagggaccatcctgctcatctctctatccccaacatctactgtggagcctggaactcgtgatgcctgtggcttcatggatgcaaggatggaaggatagatggaaggatggatggatggatgaaaggatggaaggaaggaaggaaggaaggaaggaaggaaggaaggaaggaaggaaggaaggaaggacaaatggataaatggatggatggagtaaatgtcataggaaaagtgcagataaaattctaatattcagagaaaagagagctaaatttaggtgggagagtttaagaagatgctcataggagaagaaagctcttacaatgggtcttaaagatggatggagtggccataagtaaggaggtgaatcagaggaagatactgcggggggaacagagagctgctgtccatggtaagggcagctgtagcctcatgcaaagtgcctgcatttgaggatgagaagctggcctggggcacctgcagggctcggggctgctgatgctgctggggctgccgaggcactcatgtcccatgcagcatggcctcagtcctccctgcattccctgccttttcttccttttccttcctgttttctctcccattcattctcaattctctcttctttttatcactatctgcatccacccaaatacacttaactaattaaaatctctatagtgtgttcaaaagttatttctcacctgcagtactcccttgagctccaggctgtccgttcccccaatttcattatgcccccaaaaggctgggcacattttaaaacatgttctctccacaaacacagaattccctgagcacctaagcagaattgaatggagaggaaatgaagaacatattaacttcctcttagatccccgggctgatttctttcaggctcagggctcagactgcatgataagataaccattttgtgaaaagatgaaagctgctccgtgcagggcgcattctgtgcaggtacagaacagatagggaggggcttatgtctccgtccctcctcccccgctcccatgctcaccgcttgctttctgttgcgagtgtctagaatgccctggccctcttttctaggaattggattgtaccattgtcattccaacctctcttatcagaggcaaagccccagggtgcagccctccccgcagcgtggccacagccactcagaactccagagagtcacgccccgggtggacatgtgtgtgaatcatcagcacagcaccctcagatccccaccctgaggcacagcccctcgtgtcatgacagctgtcactcatcttttttttttttttttttttgagacagagtcttgcttttgcctaggctggaatgcaatggtgcgatctccactcactgcaacctccacctcccaggcttcagtggttctcatggctcggcctcctgagtagctgggattacaggtgcacaccaccacgcctgactaatttttgtatttttagtagagatggggtttcaccgtgttggccaggctgatcttgaactctcaacctcaagtgatccacctgcctcagcctcctaaagtgctgggattccaggcatgagccacggcacctggcctgtcactcatcttttttcgtttgttttcataactaacagcatgtccaccaacagactctgagagagctcaggcagcacatattctctgggacttaatcgctgctgttggccggatgccttccacattgagatgcaatccacagacaagttgtcaagtccatctgggtgaggactccgaagaggaaaacaggttaccacgtggttagccacaccattacaacactggcgactgttcctatgatggacggctctaatctcggtgcactgggagataacaagcccatccccacgagttgagtgagaatttaacttgtgcctggagccagaagcgcgacgcagagtggactggggtgcactgagccttgccagggtcccgcaccctcaccgggagctgtgatggggccaccttctccctctccaggccccactttcctgtttgaaggatgcccgccctcaccaggagctgtgaaggggccaccttctccctctccagactccactttcctgtttggaggatgccgacagcgagacctgcccacattgcatcgctttgcatgtctagctgtgcttgatatagaagaccttctgtgtggatgtgtgacacacctcagagccagcaggtgggacacagctgtgccatgagcaccacggcccgtgtccttgtagggcctcccttccctgccttcttcctgtgccccccaagcccctcagtccatcctcaacagccagggagaccccctcaagcatcagtggcttcccatctcttctctgctcctatggcctccagactcagaagcccagcaaagtcctgttattattgccagccccacccttcaggacccagacagggcctcctcttgcctgctctccctgtggtcctcctccctggcagtgccgccacaggcaccaactcagagctgtggacgcaccgtgcctggaaccctccacccaggaccctcagagatacgtcctacttccttaggtctctgccctggtcaagccctccccaccacacttgtcccagcgggtaaaggcccgaaacatggggtgatgagccccttgccccgcgttttttagagtgtttgtcactgtctgacgtttgcctgtttatctgtttattgccggtaccaccacccaactgaaggctttggagcaggggctgtttcactcactgtctaccacggtaccttgtttgcagcaggtgctttgtaaattttgtttgaatggctgggttgagtcattaatgaaagagagggaaaggaaggcaggaaaacacttttaaaactcataccacagaagatctatctaaaacctctccaattctgtaattctatgacctcatgagaaaagaaaaaaaaacacccacctagtgaccataatgtagcaaacttcctgccgggctgggcgctggagtcgggtgtggctgcacagctctgctgccttgcagaccactccagggagctgccgggagctggacgcatgctggtgtcttaccccacggagggggcatcactgcggacagagcccagcgtgggcggccgtgaccagcagtgcttcctctcagaagctgcctgtaccttctggaaatatgaaatatggcaaccatacaaccatttctggataatacagttccacctttgaaaatggtttgaaaccacacaaacatccaggtctcatctatttggggctaagattttagaaacagtagaatttttcttacaaaacatttaaataagaaagtacaaagcggctcctgtgagcacagcagcagaatcgtttccacagaattcggcccagggatccacagtttggtaaccagcacaggattttctacagagcccaggattttctacggagcccttcctctcaagagcatcagagtacttgagaatattaaccatgtgttattcggagcaattccagccttggaaatttgcggaggatgtaaactttgccaactaacctaggggagagcttcacccaaattcttacctccactgagcccctaatgcacacttcctctttgtgtttaatccatttatttgtttaatacatttatttattcattccattatcaaacattcattgagacctctgttggtagtttaagacattctgctaagtatacagcatgactcagattaaaatggccgttggagacacaatatcaaacataaaaactaatgtaagacaaggcagagcataaacctggtagctgctgatatttactgatatcagtaaatatcctgagctgcaccccagaggtatggtcttactgtgcctgggatgatgtccagaaatttgtcctttacacacttcctgggtgatgctgaggtatagcctcggtttaaagccctttgaactatggaaaaataaaggcaaacctcaaacagataaggaaatgcaagatctcagtgagctgtcccaggaccagatcttggatcccacgactgggaaccagcagagcccactgggttctagaacctctgccagctcacccagacgagatctaaggatttcccttaagctttcctcagcagttatctggatggtggattaagtaaccatcagccatttgtgtgtaactcaaactcacattatcgggtcagttaacagatttactaatttataccttgcttcttttcatgaggaactgaagcgagaacagaaacgtgtacaatggaatgatggaatgtctactgactccacaatcatggtcacggaacgttaagtgagaatgaaggcaaagaaaagagatgtatatgactgtcacaggacctttgattattgatttaagagcctcagatgtttctctgagccatatagtgatcagagcaacacaggaaacagcttcagccacattctttgttctgtggagaaggaggagatttagaagcaaaaaataaacataactgctttcctaaatgttatgaaacagatcttttcctgagttctaaagcaagtgaagaaaaattttaagtgaagtgtgtctatattcaattttgagtttctgtgtatgtcttccttcatcacatgcgtgtatttattttattcgagctttatggggatataagtcacacaccataaaagtcacgctttaggatgtacaattcggtagcattcagtagatttacaggtatgtgcaaccatcgctctaatcaatttaaaacatcttcaccccaaaaagcaaccctgtgccttagcagccgcctgccctctcacctaccctgatgctgggaatcaacaatctgttttccattttgagatctgcctgttctgcacacttcatatgaatgaaattgtacattggtggtcttttgtgactggcttctttcccatggcataaggttttgaaggcccttccctggtgcagcacgtttctgggcttaattggttttaattgctgaaaacatttccattgtgcggtacagcccccatgtttgtccattcatccgtcgggcagcattgaggtcgtctccactttttggcaactatgaatgatgtcgctgtaagcattcttacacaggcttttgcctggatgtgttttcatttctcttggatgtgcacctcggagtagactcactggggcttttggtgactctgtgttcagcctttttaggaccctccagcctgttctcccttccccagcagcgtgcgaggttccagtttctctgcatcttcatcaagctttggaactgtgtccttttccctctgtccactccagggggcttgagtggtaccgcactgtggttttgatttcatttccctactggtgagtgattctgaacgcctttctgtgtgctctttcgccgttaggacatcttctttggagaaatattcagctcctatgcccattattatttggattatttgtcttattataatggagttgtcagatttatatattctggattcaagttccttcacaaatacgtgatttacaaaaatgtttcccattctgtggatggcctttgcatttttttgatggcatcttttaaagcataaaactttttaattttaggtagtttattttatctatattttttcctgtgctttggtgacatgtctaagaaaccattgcctggttcacagtcacaaagaaatgcatctatgttttctacaaatagctttatagtttgagcccttttctgtctttaagccactttgagttcatttttgcagattttgtaagatgggggttaaattcattgtttggtgtgtagaaattgggttatcctagcattatttgtaggagagactattctttcccctctgggtgaccttgtctcccttatcaaaagtatcacatgtgcaggtgcatgtctggactccagttcagttccatgggtccatgtgtgcatccttgtgtggggccccacccttttgattactatcactttgtgactcttgggatccataagtgtgagtcttccaacctggttcttctctttcaagattgtttttgcttctcaggacccattgcatttctatatgaatttgaggattggcttttgcacttctgcaaaaaagccatgtgaggttttgacaggaatttcagggaatctctaggtcacttggggtaggacctacctcatcttaaccattaagtctgccaatctatgaacataggatgtcttttcatttacgtaagtcttgcttaatttctttcagtagcgatgttttctagttttcagtgtacgaatctttcacgtcctttttttctttttttttttaagagacaaagtctcactctgacacttaggctggagtgcagtgatgcaagcttggctcactgcagccttgaactcccagactcaagcaatcctcccacattagcctcccaagtaactgggactacatgtgcctactactatgcctggctaatttttgtatttttttttaaagacagggtttgccatgttgtccaggctggtctcaaactcctgggctgaagtgattcccccatctcagcatcccaaagtgctgggattacaggtgtgagtgactgcgtctggccctcttttacctccttggttaggcggtcccagggactttattcttttagatgttattttaagtggaattgcttttctaatttcctttttgggtttctcattgctaatgtatagaaatacaattgattttttattttgctcctgtaacctgctcctttgctgagcagcagtgaaagtgggcatccttgtcttgttctcttctcacagggagagctttcagcccttcagcattgagtatgatgttagctgtgggtttcccataaatgcccattatcatgttggggaagttccctccagtcctagttctctgagtgtttttatcatgaaatagtgttgtactttgtcacatgccttttctgtatcaattgtgttgagtatgtggccttttcccctttgttctattaaagtgatttattacattgattgattttcctatgttgaaccacccttgcattgctaggataaattctacatagtcactgtatataattctcctcatatgctgctatatttgatttgctagtatttttgaggattttttttttttttgagacagaggtctcacttttgtcgccaggctggagtgcagtggtgtaatcttggctcattgcaacttctgcctcccgggttcaagcgattctcctgcatcagcctcctgagtagctgcgattacaggcatgcgccaccatgcccagcttatgtttgtatttttagtagagatggggtttcaccatgttggccaggatggtctcgatctcttgaccttgtgattcacccatctcagccgcccaaagtgctgagattacaggcatgagccaccatacctggactatttttgaggctttttgcatctctatttataagggatattaatctatagttttcttttcttgtctttatctggctttgctagcagggtaattctggccctgatagaattaccatagaatgggcttggaagcattcctgcctattctagtcctgggagactttgagagggatcggtgttaattcttttttaaatattgatagaattcacctgtgacaccatctggtcctgaacttttcgtcccacaagcacggcgtgcaccctgtaaacatttgctgcattcttcatatttttattgttatacttacaatatgctatttagattgggtaggccggccgccccataagtgcaacagtaagacgtgcatttacattctattctgaatttggggagatggttgtacgttcatgaataaatgactataattgctgttttctctcaatgacaaaaatggtgtcatgaagcagtggaaattaggaaactaagatgctttccgcattttgtgtttgctacctcattttcacaaaaagaaattaccagcccctaagtatttattacacattgtgcacacctaaaaaacccggagacctagcttagtgctcgttacatgttctagtgttgccattgtttacagcacgctgccattgtcattattgtgataatattttaaagtacatgtttccatgcatccatcaggaaatccagtcctgtatagtggaaatgagaatgtggtatcaacatgtggcataatcaaatttaattcatttcagttaaattttatcttttatgccattcttttatgaagccacattcataacatagcttctaggctaaacattaggcagaagtaggatacgtgagtggggcagtaatggactctctttttaatatgaaggaagattaaaattgtattaaattacacgttaatggaaaaacaaagcaaaagataataggatgacaactttatgcagctgtaaagtctggattacagcacatagttttgctatttagcagttgaatattgaatttcatttgaaaatttgcttttaattatattaaaataatatctaaatattcccccaatatattaaagtgctctcattataatttgactgtttgagaaaggaagacgccgccggccattacagtgtaggtgctcctgtgagacagcgtaggcacctgaaatataacacagtgaggctcaccttgaagttaaaggatctctttatccttcaactggggactgtttactgtgagaatatgcaggagcaatccctttgctggcctcagtgggagaaacagccccacaccttgctgtcagtctctcgggatccctcaggaaatctttacgttcccttctgcattcacacctgggtgtgagaagccggtccctgacttcccagggactcatgaaatcgtatcccttccttatcccatgtttccatggccatgctggcccagacggctggccgtcctggatcctgaaatctgcgacgttttgaggccatacctaggactagtcacttggtaaacattatcagcaggggattttgttgttgttgtttgtttgtttttgccttggttacctggagggttggggttggacacgatgggaaaactctcactccccatcactctgcttgctttccctggcatccatgttgctcagggagtcagagtgggtggctctccaagcgcagggcatgatggactcaccccaagactgcaagcaggggtgcatctcaggctgcttagggtggtggcgagagaggagcaagtgggagagacgcttatggtgacgggagagctggcaggcaggaattcgttccgggatccgaggcatggaggtggtccaggagaggcaggtattggacaaacgtgtggggggatagttcccttcctgaggagacggccacgctcagccgtcgaggtggccacttcttgctcctgtctgggtctttggcctcgaggacggcacacagcaaggccgagtggtgtggagccgggtcttggagtgaatgcagggatgcattccaggcctgggaggagaggcggcaggacccgggcagcgacatctacaaatgacggcagccgggtgtgcttaaggctcagcagactcacagggacgtgcggaccgtggggcagagggaggctcggcagctcctctggtcatcacagagcttggacgtctggtctgggcctggcactgctgcgggatggcccgtggctgtcacaaggaaggcagctgtgcccgcagggagcttgctgtcctagatgtggccctgggtgacaggctgagaagaacagggctcccctaaaagttggtggatgggctggggtgcatttgagggggtcagccccacagctgtgtctgggtggaggcagggggagagggagagagaggaggaggccatcgtgatggtcctggtgacaaggaggagggtctggggcaggaggggcctgggatggaggaggcagatgtggggttgaggggggcctgccagaaggaggaaggtgtgagtgcagagaccaggggagcaacaggccgtggagctggcagatcctccttctctgcaggtcaccccagcgcccagccgccttcccagggagagaggagagagcaagcgacctgccccttggtggctcagtggccataagacaggtggtgctttgttgtagccacagcctcgctcctccaggcattcagggaaagcccatcacaggccgcagaaggacacagggaggagtcaagcgggattcctctggggaaggaggcacagctgcccccacacagatgggacctcgagaaagctcctcccatcctcactggcctgtaagggtgtggactgaacaaacgatttcacgattaatacctgtgtatgtgatacatgagcttactagacaatatcacccatcaagtaccagatgctatttttaaaacttcttaagctgtacgacaaaactgaaatctatgtgaaatacaactatgcttttcccccaaattgttaatttcctttaataccacaaaatccggctgtcaagagacctgttcaatctactagatgctaaatcttggtcattaaccatttgggaacatcagtgtttcctctccactcctcacactttgcgatataaaaacaactgcctggccgggtgtcctggctcatatctgtaatcccaggactttgggaggctgaggccagtggatcacctgaggtcaggagtttgaaactagcctgaccaacatggcgaaacctcgtctctactaaaaatacaaaattagccgggcgtggtggcaggcgcctgtagtcccagctactcgggaggctgaggcaggagaatcgcttgaacccgggaggcggagcttgcagtgagccgtgatcgcgccattgcactccagcctgggcgacagagcgagactgtctcagaaaaaaaaaaaaaaaaaaaaaaaaaacccacaaatctgccctctcgagtgcccaggccagacatggacactgattaatgaagtccacggtgggggtcacatattccccgcacctgagggtttccgccgcgcttccgggtgttcaatgccgtttctgtttccccacagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtaagcaggctcacggccctgtggaggccgtctcggcacagcaggtggtattgtcgttattccttttttaattgacagataacaactgcatacacatttaggttgtgcaacaggatgttctgagctacggatatgttctgggacagctccactgagctgttaacacacgcattaccttacatacgtaatttttttggtgggagcacttaaaatccactctggatgatttccacctattcaatacgtggttgttaactgcagttaccgtgctggccaacaggtctcttgagctgacccctcctcactgaaatgttgtcctttgaccaacatctcccaattcttccccatccccagtccctctggtaaccacggttccactctctgctcctatgagttcagctgtttcagatgccacccgtgagagggaccatgtggcctctatctgtgtgcgccgggctcatcctgctttgcagtttcttccagctcacctgtgttgtggagaatggcagatctccttctttcaaagactgagtagtgtcccctgtgtatgtaccgcatcttctttatccatcatttgccgggagactcgaggattgacggcacgctatggctttgtgcgcggggctgcagggatggcgggacgttatctacgggcagctctcatgcgtgagtctggcctgctctgggagggcctctgaagatcccgactcctccttggaaccatccctctaaacacagtgggccatttctttaaggcctctaaggctggagggtttaacaaccacagcaaacacagacttgcccatgtgggtgttttccatgtgagagctgatggaccggcctaatggaagtgggcctgcgacattcgtgagttcactccctgcacctggccacagcctctctaagcaccccccactacaaaaagcctgattatggaaaaggcctctgtgtctctggggtgtggattaaatgaatttaccaaaggcaaaaacaaagaaggtagatccctagagctggcatattgcagaattccctgttttatgtgatttcactctctgtctctgaattgtgccatgcctgagtttactggagaagctctctgggaggcacacgctacttctgaggatgccactcagtgacttccatcagtcgatagcgctgttaaaaaaaacataacatgtgtgtcccaactcacaaatcactcttgcttgcctagagcagcggctgtgggcctcgcatcagcttagagacatcttcatggagtaatgggccattgctggctgagccaacaggcagtcaactaatgggacagggggactagcagccgtgattctttctgggagtcgtggtggcaaatccttccagtggcaccgtcaccatcaggtccagcgtccacatctcaacagctctgttttgaaaggaaatgctaaccaaattgcctttgcaggcagatttattcagagacaaattggtagttgcataaaatattattttatagcaatggaagaggcataaattttgtttgccgtcggcaaaccctaatcatatccaaatgtaaaagttgtgtctgcttgtttagagaagcctggtagaaagaatcggggttcactctgatctgtctcctcattgtcacagacacatagctctcttgtttttgtctgtgcctggtgtggatagtcagtgttccctgaatgagcacttcaggacactgtcagagcctccaggttttgccccagggtcacctgcctccaatgcctgccactctccccaagcccctccagctgcgccttctccacaggtcctgtgccccttggacctgccttctccaaggagcttcttccacccacttcctcccaggaacacgcttctctctgcctccaacagctattccacggtctaggtgcagggaataccagtcgtccacaaaggtgaagtgagacagaatgaacccacacaccgtcagcccctttcaaaaaccatccctccgaaagtgacctcattccatctgcactcacgccttcccacccaggctacactgcaacaaatcccacacgacagacagatacaactgtaaatatgcctgtgttgatctcccagagatccacacggaatgatgagtacgctttcttttgaaacataaccacctgcattatatcatcctggtcagtggtcacattcccctgagggctcactgtctcttgttggcttttatttgaatcaggatccagagaaggggcccgcctggcagctgctgatgagcctcttcatctcgttcagcccgaggtttctcctctctttcctctcttcctccccctagattttttttgtttggaaccagctggttggtctgattgtgtctgtcagtctgagttccgtgccatggggtcattccagacactctggtcctgttgttctgcagccagccacccactcctggacttccctgccctgacgccactggcctccctctcacgtccactcagatgacacatcctcggaaacaacacagagcgttatcgtgccgacattgggaagcactgcccggaggatcggaggatagaaggacgtctgcagggagcagccacggctttcatggcgctcgttcacaagggcgttttcttgcagtagcaagcttcccccatccccacatccgcctcccagtgaaaccacctcttcggggcatgcagctcggtgacttctctcccctcctcactgtcccccagtggttgctgctggacccctcatggaaggatctatgaagctgaatatcaggagctgtgtgcaacctcctcgggctgtttctgtcctaggactcagctggattgacgtctggcattttcaaagatgcctgtgcagggctgtcccttcctgtcaattgcattaaactttctggtggaaaactacaggtttctgggtcctcacaaccccagattttatttcgcagccaggaaacagggaaactaaaggaatttgtctgtgggtcctagtgtacggataagatttaaaagaataagaagagagaaataaatgtttataaattttcttccttttttcactaggagcacttgcagctgaacgacaggatcacttttcattttcacccttggtttgtacagagtatgtggttcacattagaggaagatttttttcttgtttttaagtaggtcaaaacggagaataagtggaattgaaaggcaattcaggcctcacgttattctttcacaaagctcttgttttcatcttttctgcatcagcagactaagcatctaaggtcaaacttttcatgagcattgtaggaatgcagaacggattcgccgtggcttagctcaggatgccaaaggctctctatgccacagtccaccgaaactcccagggacgtgcagggagggagagacgccgcctccccgggaaggctcctggcggcatcagatggagggacagcggggcccctgctgcatcccagagaagacccggcagcccctccagccctcggcctctgtccccgcctccttccctcctgtcctcaggcctcctctctgcagcctcccagtctcccaccgcgtcctgcgctcctggttttctcctcttctagtgtcttccccacctggcgtcgcccggccgcaaccctggccctcctggggaagaggttcggaccctactctttatttgacatgaagaggttcggactcccagttttattcggcatgttcacgggcagcagccccattttgtttggcgtgttcacgggcagcagccctgttttattcggcgtgttcacggtcagcagccccgttgtgcttggcgtgttcacgggcagccccgttagactttgggttttacctgtcaggctttttacatgttcacgtgttggaagcaaatggcagaaaagaacacagaggggagggggtgcgatgaaaacggggagccctgagcattccctccctgcgtgtaaagtgtttcagaacctctccctgctcccgccctctgcagccggtcccatcactgagtactgacctttccttgcagccattcgctgaaggacgtgttgcgggtcccatcaccgagttctgagctttccttgcagccattctctgaacgacgtgtctgttttgtaggccgtgcagatccctggctttcaggctcagctactgcatttgtgaggtttccagttaggtacaaaaacacatcttaaaagtcccatctcccaggtcaacaggtcatccttgcggtgtagtttagaaaaatcatccatcttttacaaaatggagccaggctcccctgtttcttgtctctacaataagcatttaaaaggcttgtcacagggccaggcacggtggctcacacctgtcatcctagcactttgggaggccaacgcaggtggatcacctgaggtcaggagttcaagaccaacctggccaaaatggcaaaaccctgtttctactaaaaatacaaaaactagccaggcctggtgacaagtgcctgtagccccagctactcaggaggccaagggctgagaattggttgaacgtgggaggtggaggttgcagtgagccaagatcacgccactgcactccagcctgggtgacagagcaagactccatctctaaataaataaattaattaaataaataaataaataaataaaatggtttgtcatggaatgcacgatgctggccatttgcttctttctgcccgatctggggtggaacctgagtctcatcagagttgggtgtggtggcctgggacagcctgggccacctctggccctcctgccacaggcccacctccacatgctgggtgacccctccctgctggtttccttcacgccctcagctcagcttggcctccaccttgacctttattgagggtccctctgctgcccatctgcctcctgagcccgggtcctgtctttgtcccgctttgcccctgtatctaggagggtccaacacactcagtaacaattagcgaggggcacctgtatcctgcagcgttccagaggatgctggcttgagcataagggtctctccgggcacctaggtgtcccatgttccagaacttggcaagcaggaaggacccacgcgccccagccccccctcccccgcgcccaccaccctcacggtatccccaccagttcaggaaggctggcgttgtggcttatggggtgctttcaactccagaaaaccaatagttctaacaagcttctcagaaaacttctctgtatttgtagttttaggggcaaaagagggagaaaggagattgctgtggttggttcctatccttagcgataccagtgctcagcagaatgaaagaactggccagcctggctgtgctccactctaatgcacgtttgcaatttgaaaggagggcttttgttttaagtggctcatggtatagatctggggccgtgaatggataggagagttggggtgtggccacacctcacttccaatcccgtagtggaatagcaggtccgggaggagcttctcatccccttttaagccactctggacacagacgcacaaccctgcacaatccttccgcagcccctcgagtttctggtctggatctctcctgcactgacacccagccaccagctgccccatccatccagtgtgagtcctaaaacgcctccttgagacaaagcggtgacctccgcttccaggagccacgtgtgcctgccccccacactctatgttccctgtcctgtggcccaggccacaccatttcctgactgcaaagcctgtgttgtgaggggctcctccacaactgccctgcctctgggccaccgcttccccccggccccgactgccacagaatcctctcccaccttgagtaccgtcacacagggcttggcaggatctcgctggtgctcaccgagcccgttcgtgtaatcagggaccgtctgcaggagtgcaggagctgggcctgtgccttcgagcctctcactgtctccccggctggactcctccatcaccccccagttgtcctgggactcggtgtgtcatcgctgggagcagcttggtgccgggcaggcagggagatcgctgggctgtgtcacatctcagtgacatcatcttaggacccaacacattcttatccccatgacggaaattccagcaatgtttgttgaaatgctgatggatgttgaagggtgtctggttttgggttgttggctagccttgtgtctggtaaatctttctgcctcttcaatccttcacgcctccgtttgtggtgagattcaagacagtgttccgaaaagcacattggaaatcataactcatgtgaacatggaacactgggtgggtgcatgcgctgttttatccaggtttaccaggggagaatgacatggcctacatgtaactcaagatggtcgtggatgcagagacctcatggtgactgggtgcagaaaccttgtgacctgtgactgggtccttggattctgtgatctaagaccctgaggaaccatctgcatttatgccatgacggccaccgagtggtcaccttgttctgggcacagtgccctcaacttggcagctgaggctctgcttctgcaggagtgcaggtagatggggtccggctctgtcctctccctcccagggcagatgaggctctgctcctgtgggtgtgcaggtgggcggagtcctgctctgtcctctcccacccaggacagctgagggtctgctcctgcaggagtgcaggtggacggggtttggctctgacctcttcctcccagggcagctaaggggtctgctcctgtgggtgtgcagctgggcggagtccggctctgttctttccctcctagggcagtggatgccccaggcttgtctgttcccgctgagtctgtgtctcctgcctcagacttggtggtccacatgcagtactgctctgtgaatgatcctggaagggctgacccaacccaaagtacagcaggactaggagctgttggagctcaggccggtgaactgcaatttaagttatcccttgtctgtcttggtgttaaggagtggaatggaatcaagtttgtccttaagaaaataaagtgggcagctgaactctaaacctaactctgacttggtttcagtggctcagaggaaaaaccacaacaaacaaacaggaaaggaaagacttcccacccaagctaaattgttgtagggacaccagggtggatttgagcagcatcgcgaagatctcttcagctgagatgtacatcccgggaggcagcagccatgcacccagcatttctcaagctcagcacagcgggatgggggctgggagatgcttgtggggtcggtcttatggaatgggggatgttgagcacagccatgcacccagcgtttctcaagctcagcacgggggtgggggctgggagacgcttgtggggtacgtcttatgcactgggggatgttgagcagcatttctgggctccacctactacctgccggaagcacccccatttagtgacaaccaaacatatctccagatgtcaccaaatgtcccctgggggcagaattacctggttgggaactgctggtgtcatccaaagagcgtgagctttagaacaagacagacgcgtggaaccttctcacaagctgtgcagccggggggctcacaataggggctttccatggaaataaatggctataactgtgcctgcctgacctccctcagggtcccggaaagagcccctggtgagatggacgtgccgatggccacgggtgtcctctcaacaaggagatggtggctgaggggtgaggacacaggatggggcagagggcaggggtgagcagcggggacaggtctcggccgattctgagagaactcaggtgctgtgtgaactcaggggtctccgcaccgaggcaaggagtggccgtcctgccttcatgccgccagcctgggtggtgcgtgagtcagctcgggtgccatgacgggcatacacacccggggggcgtgtaaaggcacattcattccgcagggtcctggtggctggtgcccaagaccgtggagtcccaaggccagctcctgctgagcctctcctgggcacgcagacgccgtcctctccccatgtcctcatagggttgccccctctctgtctgtctgtgacctcatctccccttcttaggaggataccaggcagacaggatcagtgcccaccctggtgacctcattttaccttcttcacctctgtaaacgtcccatctccaaataatcacattctgaggtcccaagggttagggttcaacataggaatttggaggaacacaattcaggccataacttgtgtgtccttcccaaggaggggtgtggggaaggcagctttctcccgctgaatggctgagggcatgccctggagagactcagccattggctggcacctcctggcaggttggagcaggcaccttggtcctcgaggggtgagtgtggcatccacgcatcctgggggctcccatgtgggtggggttatgccaggcatgcagcgcctctgttggtggcctcctggtgtccatgagcccgtggctcccattccaagcatgagggcgataggagctggacggggccaaagggcccagtcacgtgtgcccagtcgcaggcggcttagatgggggttttgtacactcagctgtagtgtggcccacaggtttggagatggccataggaaagacagttcacaactcacagccccagaagagagtgaggccacaccgcaggcctgggggacacacctatgggtcaggaggcaggagaagagggaagcgtgggcaggagcctttgccacagtctctgggaaggagggagacacatacaaacatgcacacacatacacacataggcatgcatgcacacccatatacctgcacacatacacatatatgcacattacacatacacacacatacacacataggcatgcatgcacacccatatgcctgcacacacacatacacatatgtgcacattacacatacataaacacacatatgcacataggcatgcatgcacacccgtatacctgcacacatacacgtatacacacattacacatacccacacatacacacataggcatgcatgcacacccatataactgcacacatacacatatacgcacattacacatacacacataaacacacatacgcacatgggcatgcatgcacacccatatacctgcacacacacatacacatatacgtactttacacacacacacacacggcttaaaggaatgcagaagacatttccctgtgggaacgcacagcaatggacgataatgtttttcctcggttccagtgcctccaagagaatatgatgatataatcctggcccctttcacctgggctttgcagcttggaagaaagaaaagatattccagtttgtgcagtgttgaactatccctaaagcaagtaacaggagacgtcaaaatgtatgcttatgtcacccttatgaaaatgcctttttgttagaaattatgaacatcacccatcactaggtacaaggaggtaattagggtaattgattggcgttaaatgcagcagggactgcaaactggatttgcagagtctggtagccgtcgtggaaagaaatttattcattccttcactgaaggccataaagccattttggtttcagagcgtgcactaggccaccctgggctgagggctgcagggttcgaatgctgtaacataacggagagagatttgtttgctgaggcaggctggcattttagtattgctcttctgttcttttgatagtctccagacatatgctttggaatggggatttggtacttgaattcatgctttgaaattgactctggttgacattctttctgtattgaaatttcttctgtcaaagcctgcgaaattggcttcttaaatcagaaacagaaacatacaagctggtctcatttgttagttaatttgcaggctgctgaagaaaaaaatctttactttgttttttatggaaacatgtttttaattcacaaaaaaaatcccataaacctgccaaagtgaatctcttctttgatggcagaggagctgctcttccatctgccaccagccagcctcagcctcccttcccgaactgagcttttcacacattcccaggagagtggcagcgtgagctcccccgtgcccaggaactgggtggccgggcctccttctgccccatcgcctctgcctgcaccttctgctggtccagctcagacaaaagtaaacccggacctcaccccaggacctttcctgatcctggcccctcccgtcagccgacagtgaccttcaacacgtgtcccctccacactggcttctccaccctgatgatgctaccactcatttcatgtccatctcctgtaccgaattgtaatgtcattgagaactgtggcttttcttaaattaaaaataagggtgtttattacaaaagtcatatagggttcatgtagacaatttaaaaatataaagaaaagtcattgaaaaccctgtaatcttcatctcctagtgacggtccctgtttcacatcttctggctgcttctgcacataacacagttacatctttaaaagacataaaaatgtcaagtgctttaaaaattgcttttccccctcatgagcatcttttcatcactaaatgcacattctggaatagtattttgggtagctgggtagtatccatcctgtgcttttcgccctcgtgagcatcttttcatcgctaaatacacattctggaatagtatttttggtagctgggtagtatccatcctgtggttttaataaatattgtaagccatcccctatgatacagtactgttgtcatttctcctctttccctgattaccaattccccagtccctgaccctgggctgcattgtcttggggaagcttcatggaaggaaagttgcccactctaaggacatgaccagtccgaaggcctccagtcatctccagaaagaccgggcgctccactgcccgccacctggcctgaagacacggagataagaattgtcaagtccccaaagttgtgaattctttattcttccttagtcatctttttccagtgctcaaacttcctcactgtcaggaaatgtaaaccaaaattcacacggacaaaatgtgaacaaaacattggcaaatgtacacctgttttcttaactgctgatttcttgctgagagaacctgctgtggctgaggccccaggcctgtctcttacctgacctacagctctgcagctctgcggtgtcatctgtgggacatttacattgaccatgtcattaatacccgatatggtttgtgtccccaccgaaatctcgttttgcctggcagctcccataatcctcatgtgtcatgagagggacccagtaggaggtgactgaatcatggggtgggtctttcctgtgctgttttcatgatggtgactaagtcttatgagatctgatggttttttaaaagggagttcccctgcacacactctcttgcctgccaccatgtaagacatgactttgctcctcattcgccttctgccatgactgcgaggcctccccagccacgtggaactgagtcagttaaacctctttcctttataaattgcccagtctggggtatgtctttattagcagtgtgagaagagatgcatacaatacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaataccctgtctgaagaccttttaaatatggaaattttttattttctttctctgtaaacagcatttggggagattctcttctcctacatgaaaaacatgctatgttagttccttgactacagactgtgggtgatgagctagttgctgtggaaagctttggagttctctacactcagcgactgcatgctgtgttcttttgcctttgtaaacgtgagtttgacctatggagtgaactttacccagagcctctggggagctgttcaaagctaatgaaccgtggggaaaagaaaccaggtcctgacctgcagggagcagctcccgcaatggaaaccattgtgttccagttccatgactttttgctcatggctatgttgggtttccagtttcacagatggtggatggaaacagaatactggcctgcactgtcatcttcatggtttaccctcccctcagagagacacgtaacgcaaacacacagcaggcagcctgtggggccgttatgggtgatatataaaatgcacgtgggttcagttctcgaacagtcagatacacagcacaggggggttatatgtatgggctctcagctctgtgcaaggcagatatatagcaagtacatgggcccagttctgtgcctggcagatatataacaggcataggtgctcacctctgtgccaggcagatgtataacatgcacagttgctcagtttggtaccatgcggatatataatacgcacgggtgctgagttctataccacacagatatataacattcatggttgctcaagtctgcaccaggcagacacataacatgcatagttgctcagctctgtaccaggcagacatataacaagcacaggtggtcagctctgtaccacacagatatattgcatgcacaggcaggtgctgagttccataccacacagatatgtaacattcatggttgctcaggtctgcaccaggcagacatataacatgcgtgggtgctgagttccataccacacagatatatagtattcatggttgctcaggtctgcaccaggcagacatataacatgcatgggtgctcagctctgtacgaggcagacgtataacacgcacaggtgatcagctctgtaccacccagatatataacatgagcgggtgctgagttctgtaacaggcagacatattccatgcacaggtgcttggtgatatgtcaggtggaatgtgatgtggctgggcaagatccttttgcaactctgagtactgagaatttgcatgtatgatagaacttggcttctagatttaaaaccgtcctcttttatttgcttgcaattaagatataagtatacaataagataggcattttctcccttgttttcttttttttttttccttttcttctctgttcagtttctcaactttcaatttcctcttataccagagggaaataaaactaaattttagccagtgctttgtcccagctgctgagattgcaagtgtcccttcttctcttacttttctcacatgttctcactttatccatagtgtttacctatcacttataatgaagaaaaaccaacatttttatattcatttccttttaggatatgcatttttatacatctgactttaactgataaatgactgtaaagaggtgtatctttatggaattgtagaggatttgtttccaaaaaggagctgatgctgccgttctcagtgacaaagttgatgcgtgtttcatgtctgtctgctcccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacgtaagtgagaccagctgccttcccactccaagcactttcccactgcctgcgagctccctctccaaaaccacttcaccgtgagctgagtgccatccatttaaactaaattgccaagctgaaaatattagacccatggctgtcaattttcaagtatttttttaaagaacaaccagagcttttgttatttatcaattacataataattaaggaagtgtgcttgggcaacttccttgtcaaattataaagccaacatgagccatcgtatctttctgatcattcagattatcctcaggacaagcacatgtctctgtttgtatgaatgtgtgcgtatgggtgtgtgtttgaatgtctttgtgagtaaaactcgttaacggaattttgttgttgactataactttgtaagtgcatttctaggcaacacatttttttgtagaggagggaggaaatggactagctttataaatataataccctacactttacatatttgcccaaaatttattattaataaatttaattttgaaaatatagacagataaaactctttgggaaatcagcaattcctatgaaccatgaaaatatgactgttactgtcaacagccacgctgctgtgtatcttgagtcccacaagttagtttgggtggtaatgccaagaactgcctggaagctacccctgccttctgcggccggctgtgaggtcctgggcaagtggataggcagggcggaactgcttctcagccttggccagtgccacataagagttattaattatgacccacacatcagacagggagccctgggccacagggccctccctgtattgtctctatccacgccgagtgcacccagtgatgagccagtgaccatataacctcttccaatacatctagttattcatcgctgttggcttacaagatgaaaaagtgaaattttaaattgaaaccaaatcttacaaattagaacttcacaaatccgaactctatcattgttgcctagttcagctaaattcaagagctatggtgtaggaatgccagacaagtcatgccctgagaccgggccgcatgtctgcccagcccaggcccatccatctcctctccctccacagagggtggtcagtgccagcttgtgggacgagtggctgagaacaaagccaaaatgttgccctggggaagctcttagacttgttggaaggaaatggggagcaggtgtttgtaagccaggaaataaccaggaaagatgattaccaggaaggggttggggagctggacagagctgggagcagagccaagttgtctgacccatctgctccagcaggaaagtgaaggattggactggatgtcagctctcacccaccttttatttggcacacttaaagacattaggagaattatgaattatctgaaacgtcttctggggaaaagcacacacatgcagaagctatgcttcgtgggtccagggctccaaggccagcctcagtcctggggttttggacccccaggtaaacagccattggttaacttcccactttaaatgtttgtgattcattgcataattctatatgtttgaaagcaaaacatgaaaaaaccaaagccttttttagaccatgggcagggactaagtgttttaagaattacgaacggcgttttcctgttgacgggttccttcttccactcattcaccatcactgccacgggtcccccaggatcattatcacctcattcttcagtggcagagacagtgtctcattcctttcttcacatcagggactggcccagagtcctgtacgaggctccagtactaacaatgttcaaaggacactctcagaactttacactggcaaaactcacaccatcacccaatgtagttgaaactcttcaaaaaaccagcggaaggatgtgagcctgaggccccctgacagcatcacctaaacactggccagacccttccctgcccaagtgggaaaccctctgggagttcactcaccaacagcccttaacacctgaccagaaagcattccatggcctcaaatctgatcagatgtgaggaaaatgggtgagatgtgctgcctacgttactcctgttctaaacacaaatccactctgcccgtggacccccatgccactgtccactcagcaaacacaaatccactctgcccatggcccccatgccactgcccactcagcagacacaaatccgtctctgcctgtggcccccatgccactgtccattcagcagacacaaatccactctgcccgtggcccccatgccactgtccactcagcagacacaaatctgtctctgcctgtggcccccatgccactgtccactcagtagacacaaatccactctgcccatggcccccgtgccactgtccactcagcagacacaaatccgtctttgcctgtggcctccatgccactgtccactcagcagacacaaatccactctgcccgtggcccccatgccactgtccactcagcacacacaaatccactctgcccgtggccccgatgccattgtccactcagcagacacaaatccactctgcccgtggcccccgtgccactgtccactcagcagacacaaatccgtctctgcccgtggcccccatgccactgtccactcagcagacacaaatccactctgcccgtggcccccattccactgtctactcagcagacacaaatccgtctctgcccgtggcccccatgccactgttcactcagcagacacaaatccgtctctgcccgtggcccccatgccactgtccactcagcagacacaaatccgtctctgcccgtggcccccatgccactgcccactcagcagacacaattccgctctgcccgtggcccccatgccactgtccactcagcagacacaaatccgtctctgcccgtggcccccatgccactgtccactcagcagacacaaatccgtctctgcctatggcccccatgccactgtccactcagcagacacaaatccatctctgcctgcggcccccatgccactgcccactcagcagacacaaatccactctgcccgtggcctccatgccactgtccactcagcagacacaaatccatctctgcctgtggcccccatgccactgtccactcagcagacacaaatccactctgcctgcagcccccatgccactgcccactcagcagacacaaatccgtctctgcccgtggcccccatgccactgcccactcaccagacacaaatccactctgcccgtggcccccatgccactgcccactcagcagacacaaatccactctgcctatggcccccatgccattgtccacttagcagagatggtgcaacagttgggtccattcttccatttatccaggatttatcactccattgatgagtccaacaaatgtcaggcattctgccaaactcgatttatacgtgccccaatcattctttttccctaaatctgacgccgtgttgtagataataaagcagagaaagcagccatgtgatgggtctggacagcgacctgcctgccagggacctgctaacttgaaagtcctcgaaactcctctgagtcactctttgggggttaatgtaatgaaagtttctgcaaaaaaaaaatattatgttaccaggaggtatcaacacatttttgctgttgcctattcgcatcttagtttatcttatattccttcacgttttatggattccaacgtaattcatttatttccattttagatgacattgctgaagctcagctttgtaactcagggaagctctcatgatgcctgttttatggacagaaacatgactcagggaaatgaggtgctggaggctgcacaagccaccaaggctctcagctgaaggtagctcagccccaagccccgtggccttcagcccatggcactgctctgtggagggcagggtagatcttcaccctgtggcactgttctgcggagggcaggatagatcttcaccccatggcactgctctgtggagggcaggtagatcttcaccccatggcactgctctgtggagggcagggtagatcttcaccccatggcactgctctgtggagggcagtggcggaggccagggtagatactgtggggagaggagagaaaggaagaaaacggccaggactgggagaattcccatagttgtcactctgtaaccctgtgtttccaggaaacaagggcacgctgagctgtagtgagtgtggacaaaattctcttgaaagattttaacagtggagatgtcagaagcacatcatagggacctcagattaaacaggaaagacaagaccggggaggcacatacacatccatgtgccgtcttcattctgctggcctccagggtcatgttaactgtgctgggaacgacttgggtttcacccacgtgaacgcccagcaccccctatgactgtggctggcaccatgatgtcgtctctgcatcctgttccattacgcacagccctttcataatgttcactcctgggggctctttcaatctaggcacatttaaatatcagcatttttaacgtgtagcaggtgaatattcatatcccaaacatgttctcctaatccaattcctcatttgtcttagttttaaaattgatttctgagttgaccattcccacctaagctttgagaaggctcagttggatttcacatgttcaccacagtgtaggtgcagacgctgtaatgcccaagaggctggctgtggaggcgtctgctgggatggagaggagagaaggatgaagagaggacacatctgctgggatggagggaggggtgaactgtgggggtgtctgatgagatggagaggagagaggggtaaactggagggacatcttctgggatggagaggagaggggtgaactgcgggggtgtctgatgagatggagaggagagagggtgaactgtggggatgtctgatgagatggagaggagagagggtgaactgtggggatgtctgatgagatggagaagagagaggggtgaactggaggggcgtcttctgggatggagaggagagagggtgaactgtgggggtgtctgatgagatggagaggagagaggggtgaactgtggggcgtctgatgagatggagaagagagagcggtgaactggaggggcatcttctgggatggagaggagagaggtgaactgtgggggcatctgatgagatggggaggagagagggtgaactgtggggacatctgatgagatggagaggagaaaggggtgaactgtgggggcatcttctgggatggagaggagagagggtgaactgtgggggcatctgatgagatggagaggggagagggtgaactctgggggtgtctgatgagatggagaagagagaggggtgaactggaggggtgtcttctgggatggagaggagagaggtgaactgtgcgggcatctgatgagatggggaggagagagggtgaactgtgggggcatctgatgagatggagaggagagaggggtgaactgtgggggcatctgatgagatggagaggagagagggtgaattgtggggtgtctgatgagatggagaggagagaggggtgaactgtggggtgtctgatgagatggagaggagaaaggggtgaactggagggttgtcttctgggatggagaggagagaggagtgaactgtggggtgtctgatgagatggagaggggagaggggtgaactggaggggcatcttctgggacggagaggagagagggggtgaactatgggggcatctgatgagatggagagagagaagggtgaactgtgggggcatcttctgggatggagaggagagagggtgaactgtgggggcgtctgatgagatggagaggagagagggtgaactgtgggggcgtcttctgggatggagaggagacggggtgaactatggggcgtctgatgagatggagaggagagagggtaaactgtgggggcgtctgctgggatggagaggagacagggtgaactgtgggggcgtctaatgagatggagaggagagagggtaaactgtgggggcgtctgctgggatggagaggagagagggtgaactgtgggggcgtctgatgagatggagaggagagagggtgaactgtgggggcgtctgatgagacggagaggagagagggtgaactgtggggatgtctgatgagatggagaggagagagggtgaactgtgggggcgtctgatgagatggagaggagagagggtgaactggaggggcatcttctgggatggagaggagagagggtgaactgtgggggtgtctgatgagatggagaggagagagggtgaactgtgggggcatctgatgagatggagaggagagggggtgaactatgggggcatctgctggaatagagaggagagaggtgaactgtgggggcatctgatgagatggagaggagaaaggagtgaactgtgggggcgtcttctgggatggagaggagagagggtgaactgtgggttgtctgatgagatggagaggagagaggggtgaactgtgggggcatctgctggaatagagacgagagaggtgaactgtggggcgtctgatgagatggagaggagagaagggtgaactgtgggggcatcttctgggatggagaggagagagggtgaactgtgggggcgtctgatgagatggagaggagagagggtgaactgtgggggcgtctgctggtatggagaggagagggtgaactgtgggggcgactgatgggatggagaggagagagggtgaactggaggggcatcttctgggatggagaggagagagggtggactgtgggggtgtctgatgagatggagaggagagagggtgaactgtgggggcgtctgatgagatggagaggagagaggggtgaactgtgggggcatctgatgagatggagaggagagaggggtgaactgtgggggcatctgatgagatggagaggagagagggttgaactgtgggggcatctgatgagatggagaggagagatggtgaactggaggggtgtctgatgagatggagatgagagagggtgaagtattgggggcatctgatgagatggagaggagagagggtgaactggaggggcgtcttctgggatggagaggagagagggtggactgtgggggtgtctgatgagatggagaggagagagggtgaactgtgggggcatctgatgagatggagaggagagaggggtgaactgtgggggcatctgatgagatggagaggagagatggtgaactggaggggtaatctgatgagatggagatgagagagggtgaagtgtcaggggcatctgatgagatggagaggagagagggtgaactggaggggcgtcttctgggatggagaggagagagggtggactgtgggggtgtctgatgagatggagaggagagagggtgaactgtgggggcatctgatgagatggaggggagagaggggtgaactgtgggggcgtctgatgagatggaggggagagaggggtgaactgtgggggcgtctgatgagatggagaggagagaaggtgaactgtgggggcatctaatgggattgagaagacagaaagggtgaagagtgtctgagagaaaagtcctttagacccctgactgccatccgtgggtttcacagcttggggagcatattcttgcttaagttatatttagtcatcaataataacagctcgtttattcgggaagtatgcaggaaacatcacgtgctgttctggtgcccaaatgcaggtaaactaacaccagagaatggagctttcagtccagatgctggcaagcaagggcctgccaagggccttttttgtgaataaagttttattggaatgtggcccgctcactggtcatcatgttgctgtgggtacctcccagcttcaggcagggctgagcaggtgtgaggcaccccgacagccggcagaccctagaatacttacatctgggcctttacagaaggtgtgagctgaccccttagaatctaacagacccagtgcacttcagtgagtagtcataagtggcgtaggtaacttacaagtgtaaagtgaggtgctctctaaatgcgtgagacaggactcctaacccattctgggagctccaggcttgtctccctgcagactcacatttgcattgaggggtccaccctagagcattagggtaagcggtgggtaggagagcatcagccctgcacagagcaggaccaagttcccaaagacagcatatttacgggagagggaaataatattttatagtaacactatttcatgttgaatgccaactctgttgaatcactcaggtgcaatcagaaaatggaaacaggttctgcgtcaccagattttagtgtatggggggtaacgtgagacaggagagcaatgaactaggcacagcaccggcaataattgcaggacttgtaatacaccaagaacaacagccatcccagccctcgccgctctggtaactgtgctgaagccaacaccatgacccaagccttagagatgaagaccctgtctcagcgagtcacaccaccggaagtcaactctaggtctctcagttttacgcggctaaaccatgctgccccctgcccccggaggcagcagaatctcccctcggtgatgagtcacctccctcggtgatgagtcctgtgtgtggtcttcccaccagagcctcaataccatcgagcaagcacatttattaaacagttagttgacatttccattttgttatgacccaaatcatgtgttactgcaaataaaagcttccacttaggctgagctaagcacctttactgtgctgagttgataaagttggttgacccacattaaactgccaataatcagccaatatttaaaagcagaaattgtatatggttcaacctgatcattccggacacaagaaaggaaacccacgaacatacgtgtgacaggcatctcactctgcataaatatgtgactcatgagattttgcaagcattgagaaaatacctaatgagtcttgaagatgtttcttcgcctaagaattgtatttggaatccactgttgtgcttcctgctagtgactgagtatcttccacaaacacacacgtgtgcacacactcactacacagggacagagagaggcaagcgagggagaaacgcaatgttaggtcataataacgcacaacaagagactatgaacaatacaaaaaatcatcacagacgacagagtttcttcctctttaggagtgactagtattccacaccgtatctgctgcattttcatccactcaccctttgatgacagaggttgactctgtgacttggcgattgtgagcagtgctgtggcaaacgtgggaaggcagacgtgaatggaagcagagggcattaggttacatgaaataagccaaaatacagaaaaacaaacaccgcaaatccccacctaaatacaggacctaaaacaatggaactcacaggtgcagacagtggaatggaggttacagaagctgggggtgcggaaaatggagagttgagggtcaaaagaaccaccctccgtgagacaggaggatattctttattattattattattattattattattattatttaagttctagggtacatgtgcacaatgtgcaggtttgctacatatgtatacatgtgccatgttggtgtgctgtacccattaactcgtcatttacattagatatatctcctaatgctttccctcccccctccccccaccccataacaggccctagtgtgtgatgttccccttcctgtgtccaagtcttctcattgttcaattcccacctatgagtgagaacatgtggtgtttggttttttgttcttgtgatagtttgctcagaatgatggtttctagcttcatccatgtccctacaaaggacatgaacttgtcctttttatggctgcgtagttttccatggtgtatatgtgccacattttcttaatccagtctatcattgatggacatttgggttggttccaagtctttgctattgtgaatagtgctgtaataaacatacatgtgcatgtgcctttatagcagcatgatttatagtccttccggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgcgatggtgtctcattgtggttttgatttgcatttctctgatggccagtgatgatgagcattttttcatgtgtctgttggctgcataaatgtcttcttttgagaagtgtctgttcatgtccttcgcccacttgttgatggggttgtttatttttttcttgtaaatttatttgagttctttgtagattctggatattagccctttgtcagatgagtagattgcaaaaattttctcccattctgtaggttgcctgttcgctctgatagtagtttcttttgctgttcagaagctctttagtttaattagatcccatttgtcaatttttgcttttgttgccattgcttttggtgttctacacatgaagtccttgcccatgcgtatgtcctgaatgataatgcctaggttttcttctaggatttttatggttttaggtctaacatgtaagtctttaatccatcttgaattaattttagtataaggtgtaaggaagggatccagtttcagctacgtatggctagccagttttcccagcaccatttattaaatagggagtcctttctccatttcttgtttttgtcaggtttgtcaaagataagatggttgtagatgtgtggtattatttctgagggctctgttctgttccattggtctatatctctgttttggtaccagtacaaggtaatttatagattcagtgccatccccatcaagctaccaatgcctttcttcacagaattggaaaaaactactttaaagttcttatggaaacaaaaaagagcccacatcgccaagacaatcctaagccaaaagaacaaagctggaggcatcacactacctgacttcaaactatactacaggctacagtaaccgagacaggaggatattcttcatgtttttagatcagtagcacactgaatactgcaagtaaatgagtactgcacatttcagtatcactgagtgaatttctaatgttctcatcacaaaaaatgtgaaatatttcagctgatagctgtgttaattcacttcatttttctacattgtacttaaaatcacaacacactttttaaccccgtaaatacacatactttgtcaatatacgataaaaattttttaaggggctgggcgcggtggctcatgcctgtaatcccagcactttgggaggccaaggtgggcagatcaactgaggtcaggagttcgagaccagcctggccaacatggcaaaaccccatctttactaaaaattcaaaaattagctggtgtagtggcacatgcctgtaatcccagctactcgagaggctgaggcaggagaatcacttgaacccgggaggcggaggttgcagtgagccaagatcgtgccattgccctccagcctgggccacagaattacactctctctcaaaaaaaaaaaaaaaaaaaaaaatttaaagcaagtaaatgccacaggatatccaacaagaggtttattgtgagaaatggaagaggaaaggcatccctgctggaggctgcagcctggtgtccctgcagcagggacaggtgtcaagagcagcccggggccaggggagtgagaggagcctgcaggacccaggaaggagcagcaacctcggattcccacaggggcacacagcatgctggggaacgggcagcactcagcgtggtcagcactgaccttcctcctcaacctgcccctggccccgcaagtcctgagccccgcccggtgcctccgaggtgccactggcaccagcgcgagtgctcatagctgccagaggcaaggtgtggaaatctgcattaatgtaatctgataacgttttgttggtaaattacgtagacactcttatactaagtttatcttatacccaaagtctgctttaaacaaaattggtgattctataattgtattttaaacagaattgaaagtaattggatacagtgcactgagtgtttttctcttttttgcacaaaagagcttcccagcaggagctgactgacaaaatcttttacgtttccaagtgattcaaatgataaaaatgataatgaatgtttgcttgtctccatgaggcttttattctcctcttggtgtacatgaacaacttctcttcacctgaacaatagttaagaatgcaaatgttatgggaagatcgacttgctaattgtatttaattttaatgtgataggtatgggttcaggttcttaccccggaagttatcgggcacaccaagtccttgggaggctctgggcacctgcgttgactgtgccgtcccgtgagatggaacgtgtcagcagttcttttttgactgcctggtacgggactggaagaaggttgggtctttaattggctgttatcagccctccttctaaaccacagagcagagcactcctgcaaagactgcaggaattctgcttcaaaatgttccacctcttggaacaatgccagaattattctgttaaaaaccatcttatcttcctgctgtaaaactgagaaaaaatcagtcttctcgttaatcacttaatatgcacatcctaattatatatataagcgttttcacttataccctgctatgttctctaacatagtgcaagataatagaaggccttttgctctcaaaaataaaaataaaaacaagcagaaatcctgtcccacctgtctcatgccctggtgtacagaccctcggccttgtgtccccgatcgggaaggtcagattcccagggctgatggccccgtctgtgggtcagaccctgcccacgtgcagagcaccacttagaattattatcaactaattgaaatgcaaattccaagtcctactgaatccaatttactgcatttctaaattagcttatgtattagtgattgagatactggacttgcttatatattaacatttgaaatacttgaataactaattcaattctgattgtgatgaaaggtagaccaaataatttcatttggaggcctttgcttttttttctgcttagttcaattagaaagtcaaagctctaataattttgaatgtctctgggtcattctctaatgaaggtagcactttaaatttataaagaaaaaagagcttatttcaaagatacttcatatcatatgtaaagataaattctgatggattaaatatgtaagcattaaaatcgtatatatacacacacatatatgtgtgtatatatatagacacatatgtatatgagtattctgtactctgggggtggagaagacgtatctgggcatgattccatggggcgtaattataaagataccactttaaattcataaaattaaaaacttatttatgatacaagccaacaagcaaactaaaaataatatcgccaaagtaaaatcataataaaaacctgagagtttttcaatataagtaacaaatgtttatatttttaatatataaagattgccttacaaatcaataaagaaaaaaatgaatgacgcagtgcaaaaatgaataaaggccaagcaaagactattcatctaccttatcaataactaaaacgtttggagagcatgccatttaaaactgaaaatctaaaagtttattctagagaaattcctgagaagcatgcaaagacgtaaaaaatacagccacgttcactattgtgttacatatcgttgcgtgacacggtacattgcctaagtgcccatcgtgggcgttggtttgggtgatgtgggggcactaaggaagcccccaccatgcgctgctaccaccctcagcaaaaggctgctctggaggaggtaaagtgtgtgctgcagcacaggcagccgcagggcagcacgactcagccagctctgcacctgacctgatggcctcaacacctccaccgaaagcctgatggaataagagccccgcccatttcccagcactgataccattcacatccattcccactgttctgtacacgatgaccaagatttcatcaaaatttaggagacaccgtaaaattaaagctcattctcaagacacagggcaatcaatacaagattcagaagtgacatggatgttccttcaaactctcagagaaaacgtgaaagtaactatagttatgcgatcaagcagcggcacagtgggcctggctaaatgggaagcagtggagagaggagaactctaagaaagaggcagagggaaagaccacagatggggttcatggtttcagaaataaaggattttgctggtgagtcatcagcaggctcgacataacgaagaaatcagtgaccttgaagataggttcatggaaattacccagcggaggctcgaagagaaagcgtgggaatcgaaaggcagaaaagagcatccgagagctgcagagagctatcaaatgttctcacacacatagaacctgaatcccagccagaaagacgaaagcagagcagaacagaagaaacgtgggaagcactaatgccagggagtttctaacattagaaagatagatcacatcacagactgaagaacctgagaaaatctcaaagacagatcaacaccagaaacaaaaccccatacacatctacacaccacagtcgaactaccagaagtgaaggatacagacaaacccccacacatctacataccacagtcaaactaccagaagtgaaggatacagacaaaaccccacacatctacacaccacagtaaactaccagaagtgaaggatacagacaaaaccccacacatctacacaccatagtcgaactaccagaagtgaaggatacagacaaaaccccacacatctatacaccacagtaaactaccagaagtgaagtatacagacaaaaccctgcacacatctacacacaccacaaactaccagaagtgaaggatacagacaaaaccccacacatatacacacacaccacagtcaaactaccagaagtgaaggatacagacaaaaccccacacacatctacacaccacagtcaaactaccagaagtgaaggatacagacaaaacaccacacatctacacaccacagtcaaactaccagaagagaaggatacagacaaaaccccacacacatctacacaacacagtcaaactaccagaagtgaaggatacagacaaaaccccgcacatatatgcaccacagtcaaactaccagaagagaaggatacagacaaaaccccacacacatcgacacaacacagtcaaactaccagaagagaaggatacagacaaaactccacacatatacacacaccacagtcaaactaccagaagtgaaggatacagaaaaaaccccacacacatatacacaccacagtcaaactaccagaagtgaaggatacagacaaaactccacacatatatacaccacagtcaaactaccagaagtgaaggatacagacaaaactccacacacatctacacaccacagtcaaactaccagaaagatacagacaaaaccccacacatatacacacaccacagtcaaactaccagaagtgaaggatacagacaaaacaccacacacatctacacaccacagtcaaccagaaagatacagacaaaactccacacatatacacaccgcagtcaaactaccagaagtgaaggatacagataaaaccccacacacatacacacaccacagtcaaactaccacaagtgaacgatacagacaaacccccacacacgtctacacaccacagtcaaactaccagaagtgaaggatacagacaaacccccacacatatatacacaccatagtcaaactaccagaagtgaaggatacagacaaaacaccacacatctacacaccacagtcaaactaccagaagtgaaggatacagacaatccccacacacatgtacacaccacagtcaaactaccagaagtgaaggatacagaaaaaaccccacacacgtctacacaccacagtcaaactaccagaagtgaaggatacagacaaaaccccgcacacatacacaccacagtcaaactaccagaagtgaaggatacagataaaaccccacacatgtacacaccacagtcaaactaccagaagtgaaggatacagacaaacccccacacacatgtacacaccacagtcaaactaccagaagtgaaggatacagacaagccccacacacatgtacacaccacagtcaaactaccagaagtgaaggatacagataaaaccttaaaaaaaaaaaaaaagaaagaaagaaaattatagaccattatgtacagaagaataaagaattacagcacacttttcatcgtaaatgattctggccagaacaccgtaaagtgacatacttaaaacaggaaaagacgttagcccagaattctagaatgagagaaaatatctttcataaatcaaaatgaaaaaagtcatccttaggaaaaaaaaaaaaaagctagggaaattcattgctagcagaccagtactgcaagaaataggaaatgaagttcgttcttttcttttcccccgccaagatggagtctcgctccgtcacccaggctggagtgtggtggcacagtctcagctcactgcaacctctttctcctgggttcaaacgattctcctgcctcagcctcccgagcagctgggattacaagtgtgcaccaccacacccgactaatttttgtattttatatttttagtagagacaagagtttcaccatgttggccagactggtctcaaactcctgacctgaaatggcccaccctcctcggcttcctaagaaaggaagttctttaagcatggctctgaaagaagagggcagcaggaacttagaactgcagtgagagggagggctgcatgtctcggttttggtggtggctgcatgaccgtgcatttgcggaaattcttacagccatgcagaaagtgagacgcactgacccattcagcatctgaaccagagctgcaaaagtgaatcttatgaaacaatggatcgtggaggataaaacagaatcctgtgaagccatttctccaaggtgagaaataaactgtattcttgtacgggaagagaaggggcatacctcagcctcctgacacttccgttttgggatatgtttgtgagtaggctatttaagtcatgagatggctccaagcctcttctccctcccatctgccatgggttgggtgaggtgatcaagtgagtaaccaagagaacaccagctattgatggacgcatctgagaagagctcagaagacgggctcagatattcctctggcccatgagcctgccctgggatcaccttttgctccacacagcgtaacaccaccatgctgggcaagctgggtacctggcctggggatctcctagcatccactggcctgtggcgggtggctgtgcctccgtaggcagggagcgtcggggctgcttttgagaccttgcagagtcaggctgacatctgattaagaagcctttcaaagaaatcacagtttttgcagaatccatctagaaagatgaaagacccttcagagccacttcctgtgtttctaagcccagcagtcctgacgtttttgcctttcctgatgctgagactccatttggtatctgggctctcacagcttccttcagatcactcagctcctagcacctctcggccaccagctccaagtcctgcctctcacatcaaaggctgatctcacgtctcagctttctgtttgagaccctccacgcgctggttgcaggggtttgcctgatcccagtgcagatccttcgtgatctgcccccggaaagccttgttcccctgacaattttcttcctcctcgctcctctgacttgaagtcggctgttcaccgtctcctccttgctgccggtcatccttccatgcccagctctgattgcctcctctgggaaggctccctggagttacgtcccctgcagcatatttcctcactgctcgtgcttgtctctaccacatgcctgtttgctttcccgagagtccctatagcctttgaaagcaagagctgtctcatttatcattgccattgcgccttcactgtgaggcattatatgtgctcctcacacactggatgaatggataaaaccatcgtcttatgactcatttgtcagggattattgataatcaacttaataaatgaactgctattagcgacgccgataaagtaatcctgtttagagcctaaacataaagataatcaatttaaaagacgtgtgcaaagctgattcacattcacctgatttcttaagctcctttaggttctattagtcaaaacgggagcagacgccagactcctcgtgcatgccacacacctgcaacctgcagttcttcagttaataggaagccatatgctcctggggaggaggcatcctctctcacagtctcctccactaccgtgggctgctggctcttcatttttagtttcagctggagggaagcggaggggagattctggtccagcctgtgttgcaaccgttgccagcacgtgcagagagagcatttgcactctgatcggtccagccctaggggttcccaggtccctgacgatgtctctcctcagaagctcaggcatctgggcatgaggtgaggacctggggattcgaatggcacttggcacttgctcctgggggtctctgcccatcagggaagcagctcaccccacacccggcggacccaacaggcagccatgaagaagggcaccagaacattatccatccacctgtttcgtgctgtttccagtatcttaccttacatctcttcatggatttcattgtttctctagtaaattcttcactttttacctcatttctttcttcttgtgcataccaactctagtcttattctaacttttttctattagaaaaaatgtccttaacgttaaatcaaaaacttaagtacaatgaaagacaaattaaaaacttccatttttaaattttgtgctttacttattcttttctgttatttctatgtttctcatattttacttcaacatctagtttttggcctgctacaactgatattgttttcatgaagaccttagttaagagggaggctcctaagactggcgcctggtttgttcattaatactcctggctgtgaatgagggctcacacctgtgatcccagcactttgggaggcggaggcgggcagatcacttgagatcaggagtttgagaccagcctggccaagatggcaaaaccctgtctgtactaaaaatacaaaaaattagccaggcattttggcccgtgcctgtaatcccaggtacccaggtggccgagccaggagaattgcgtgaatctgggaggcggaggttgcagtgagctgagattgcaccactgcactccagcctgggcaaaagaccgaaaaagaaaaaaaaatactccttagggctgtcagttcagggggctgtagtgagtgctgtcttttaccatccagcacttttatggcgaactgcaactgaaaaacacataatccacagaccacgtaagcttttctttttttaacccaactgtgccattgcaggtgcaaacaagaaatgcagcttagcgagctcaccacagggagacatccctagagatgcgtctctggaaaacctggcggccccgtgcccccaccacccagccgtgggcagtgcctgggcagtactgtagccagcctctccatacactcgcagtccattcattaaatcagttattaaactgatgcttaaactgtaaaattatgactcattgtaaagagctaacacacgtaattgtgtgaagtggagtgtcactctgtctctggcatgtccatcgccaggggtttccactgcccatgactttatcctgtccggacactttcgtgtgtgtataaaaatatacacatatgggcgtagtttacaataaacatgaggtcccactgcacgcattactgtacaatttccttttttctcccaaatattttgttagttttccgttgctgtcataaaaactgccacaaacttagtgtcttaaaacagggcgtttatcctcagccaagtcctgcaggtcatgagccaacacgggtttctctgggctaaggccgaggtgtcggcagcctgccctccttccgggtctctctgggctaaggctgaggtgtcggccgttggcccttctttccggggatctgcgtggggagtggttttctttcacatcaagatgttacagttgcgggaccgaagccccgtgtccttgttgtcagctgaagtcagccccctgtttccagaggccacccacagggatgtgttagctctggcccctgcctgcatcttcagagccagctggacggggtgtggggtctctctcactctgcagacccctcctgtctcacgtccacatcgatctccgacttgctctgccttcctcttctgctttcaatgctcctgcgctgagagggggcctgcctgggtcatcaggagattctcactaccccggggtctgctggttagcaacctcgattccacctgcaaccttcatgcccgcttgatgtgtagcgtaacgtgttcacagatgtggcaccagcgtggaaggccctaggggtcagagtcccgcctgcagaggtaccacgtgcgtccttctgtggcggactctaggcccagatgtcactggacggacacactgctgcgtgactttaacattaccgttggggaactgcctctatgtttttattactgcacagagtgttgtaaagaaaatatttgcgaatgctcaaccaccagtctacttattgccaaggtatctcttcttctgggtagcatcataaggggattttctgggcatgtggctccctctgaagcttttatgctttcaccttcatcagtgcagctaaggagattctgactagaatggaggtcttccaaattgcttttttctaatgggctgattatacccataatctatgcatagtttaacccctgcctctggaaagtcctagcgggaggggcaaggatcccacagacactggcttattgcctgtttccctaaaaacattacaggatgctttcttaaaaacatcctacttccaaagggcagtttgagaatctcctaattttaggcagcaaagccttatcccaaatactggtctctttgcagaaatccattgcccgttcatctataggaactatttaatttcaggaaataactttcttaggagatttttatagatttgcttctcaggaaaaataactttgcctatagtggtctgccagcttcagggggatggtcttgaaaaaggaaaatggtgatctggggtgaggccagagaggaactggctcttgggtggatttatacattttcagttgttttctaattcattaacttctgcttttattgctatttcttcttttgttttcttagacctatttgttgtttcattctttatctgaaagtatatttactaataaaagtatataaggctatgaatgtttctaagaatatatcttagctacatcacacatatattgatagatgatgcttttatagtcactgttatctaaatactcagcaattttgactttgatttccactttgactcaaggggtgaatgaatgaaatgaaggagagatagggttactattaaaaatatagctactattaattatttttctttctttaaattactttttcaaatttttataatgtgtaaaattatttaatagtggccattttctcttttcaggccctgcttttggtagggagttcggttgagagacataaataaaataccatgatttttttccatttctaattatatgaagtcttaactttccaaaacagttaagtcattcatgataacactcagagccacaaaatgcatttactagctcttcactataccaatgagctacttttctgagttttcctgtaactgtgacacgtgcattcctgccccataaccaagggccttacctgagttcatcacgtgactcctaatagagttctggtagcacaatagaaaaataatttttcacattcgcacgatgaagagtgttcagaacaaccattccttaaatatgagtcactctctttactgtcatagccttcagaatgtctaacagcagcagcacggatagttcagctaaatacttctgtatttttagctgaaaaaattcatgcaaggctttctgttcatgtctcttaatctaatggctattgaaggtgcgaccttcgagattccagagaatgtactgaatgaagagaacagagcaaaaaagagtccaatctgtaagatctgaggacacagttaagtggaatcacaccattagtagaacccggtgctaaccttgaagcagcagcgagttttactaaacagctcatcttatatgtaattctccccaatagtaaagacaatgtgttctatgagttcattgtcttctttggcgtatgatgcctaatttatgaattttttcatttattcattcggtaagtaaatatgtattaaggactgaatagataaataaaataattgtcaagtaaataatatgtgtacagactgttaaaacattaacagtgtttaacagggtgctgtggctcaggcctgtaatcccacaactttgggaggctgaggcaggtggatcacttgaggtcagcagttcaagaccagtctggccaacatggtgaaagctgtctttactaaaaaaaaaaaaaaaaaaaaaaaaggaaaaaaaattagctgagcatggtagtacatgcctgtaatcccagctactcagaaggctggagcaggagaatcccttgaccccgggaggtggaggttgcattgagccgagatcacgccactgcactccaacctgggcgacagagtgtgacttcatctcaagtttggagggaaatctgccttactcaaaatctgccaatgtgagcattaatctcttgtaaaacacaccttcacattcaggtatttgagcaaatgccatggtaccatatcctagttgacacacacaaactatcacacacagcaatgaaaactaataatgtatgaatgcacagtaatcccaatggtggttatctctgggtttgtggttgaattgtattttcttttaaatattttccaaattttctgcaaaaagcatgtagcactaaaataagaaaagataactgaaaaacattagtttcgttgtcttctaggccccctagcaacctataagtacagtttttccaatagtaacactgcatttaaaaacaaattatccttgtattgcagttaccatagtaataaatttgtcatcaacagctttattttacttttcagctatgagtggaacaataattctgtgtgtttcaaagcctcagaaatgaaacttattccttgcatgttgccacattttgtgtctccaaggtaattttttttgaggtagggtcttgctgtgttgcccaggctggagtgcagtgggaggatcacagctccctgcagcctcaacctccccaggctctaatcctctcaccgcagcctccccagtatctgggactacaggcttgcgccaccatgcccagctaatttttgtttttgtttttgttattgtttgtagagatggggtttcatcacgtagcccaggctggtctcaaactcctgggctcaagcaatccacccgcccaaggctgtttttaaagaagatgtacagtaagggaatacgtagagacagaaccacattacagggagtggttggggtttgctgttagcaccggggaatcccttgccttgatggagggtgaggaatgcgcatttgagtattgctagaagctttctgaggtcacttctgaccccgcaacaccatttacatttgggggatggactgtactagtttctggggctgccataacaaagtaccacacacagcgtggcttaaaacaatagaaatttaccctctccagttctgggagccagaagtctgaaatcaaggtgtgggcaaggcctcgctccctgcacgtctctaggggaggatccctccttccgcctcagtgtccgtggctgtgggtgcatcactccaccctcggcctctgcctcccaggaccttccccatcttcgtcccttctcctcttctcataagagcactgtcatcctcggagcccactccggtgacctcatctcaactcatttcgtctgcagtgaccctatttccaagcgaggtcatgttctgaggcactgggggtgaggatctccatggacctcttctacagggagacacagttcaggccgtaccagaagcaatcgcgtcgccaggataatgaagtatgcataaaatggcacccctctatcttggtaattatcagacactgtttctgaaacttatttccatctccgtgttggcttttctcttccggaatgtatggtcaaatataggatgtcatttctccagctgggtgaccatggtgattttgctgctgactactggaagggaagcacggattactcagctgaaacctgatttcctttcctcagttatctgtcttcaaatcagtttagcgattgttggtgattcttcatgaagagcagtaactttagctggctaaaataaagagaaatgtgtactccacactctcaaattccactttaatttcatgattaactgagtttgtagttctaagaaattggttgctcaaaatcttgttctgtcctattcacttgaaaatgggaatcccacctctgtgctcctgggtcctgagggacattccttcctccccatcccgttcggaggctccctctggtccagagcagacagccccttgcatccctgagccccacccctggcagaggccttcactgtcaatgtcattaccagggactggtggatctctatcccttaaccattctttaagccaccttaaagaagccatcttcaatggtgttggaggaccaagcaaaacatatgtgcttctagtcttgggataattaaggaagctcaaaacatgaggatgtagatatgaaaacatcttacacattcttgcccttccgtgctcgggacccaaccccatgccggcagctgcagaactgggtgcactcaatctcaggtgcagcccatgaagacaccagcccttagccctgtccagacagacctgatgtcttttaaccttcagtctgttttcctattcaaagttctgttcttcccttccctctgcaaagcccaaacattaatttctagggaattacagggaagggaggttagagcatgggggtcactcacaccccctccccctccctcttcctaacgctggctccatgtgggccaggtgggaaggaggatggaggagaaagaaggctcttgactgagcaaaaagaaagggccctcctggtctctggtcactgcttctctaagactggacgttggactgggcatttttcaattcttttgagtttcctgatggggtcttcccctcctttcttttctaacatggagagatggctcagcctcccctttcctgcctaaccccctcctcccactccacctccactgttcacccctgcagcctatttgtggggtacgtttctttgggactcactgtgggtaaaatgacccacacccgatacttgtcacacatctacttgacctgcaggaaatatgcgtgtgattgctctacccaaaggcatgtgtgcagccagtttacaccccacacacccgcatatctcctggccccacatcacacccaactgcatcctggatctccagcgggaggccctcacccatccccagcagagggaaaccctgctgcccttcacgtttgtggattctgaagccctcgcttggcctctgcgtcaataattctgacatgaactacaaactcccacggactcccagggaggttcctcccacccggggcggtggatggaggaggagcggagggaggaggtggcatgcagacaggccttggaaatccgagcacattttccaggatctagcttcatgcctcctgccacacgattctgctgggagctggggcagtgagtatccagtctcatttatcccttatccaccatggcccttgttgggcccagacacacaaacagctgcgatgggtgcagagcaaggtgccccagcacacgcccgcccaggcttacctaacggggccatctcctggccgcagctctccatggttccccactgccagtttagtccagttcacatttaccaagatccttcacaaaatacgcccccatcggctgtttcttattagtctaaggttgattatgttcgattatgttcagtaaaaatctttaattatgaaaactctgaaaatcttcacatactattttttatccctttctaacatctttatattgacgattggcctgacgtgtgcctctggcccccttgactttacccctgtgtttctgcttggaaagggctccctgaagtgcaaatatggtcctgttgcacatttgccccctgaagctctggaaagcggtccccaaatcccatccggatgtaactggaaggaaattccaacatcctcctagtccagccgagggggttcccaccacggatttccttttcagggctcccattgcattactggacaacttctaactattgaaaattttccattgggagaattctccgtgtgtcatttttctgtagttccatttaatgcagtgatagttattttttatcttctgtgttttctctacttcctgattaaattatgacctcctcaaatggaagggcaatataaactcatttctttttattatcccacagtaattgtcaggctcagacttctctgtgagcatcaccgactgaccagggtaccgctggctgggatgttacatggagcagttacactagcattttagtttcaaatggatgcagattcagcaaacactttgattatctaaaatcacagcaggatgatagattttactgtctactgatccttacatttatattatgaagtactcaaattatttattaattcagcatttgtgattatacattgcaatagtaaaaatcttttggggagtgatttcaacaagataatggagtaggaaggtctgggccctccttcccctcaacaaacacagccgttcaacaatgatttgtggacaaattccctttacaaaaatttagacactaggcctggcgtggtggctcactcctgtaatcccagcactttaggagaccaaggcgggtggatcatgaggtcaggagattgagaccatcctgggtaacacggtgcaaccccgtctctactaaaaatacaaaacaattagctgggcgtggtggcgggcgcctgtagtcccagctactcaggaggctgaggcaggagaatcacgtgaacccaggaggcggagcttgcagtgagccgagatcgcgccactgcactccagcctgggcgacaaggcaagactccgtctcaaaaataataataataataaaataaaaataaataaataaataaatgacactaattgaaaatctcctgcaccttgggaaaatacaaaaccagacttaccaaagatgctcgggagattctctcaagaattcctaccctggcacagcaccctacaatcaggaagagaccccctggcttctaccttctcccaggggagggaaggatcagttagcacatccagcaccccaacttttccaagagagctcccagagtctggcctctgacctgcaagcattgggcctgctggagtctggcccactctggttgcctgggggagaatgaagacagtggcatggctggtagatgccgtagatcctctccctcctcagcacagaataagcaaacaagaactccatctctcagcttcccactgaagaggaaagaggtgatccatgcatcccacacctcagcttcttcagggttgcacagagaactggcatctaccttccaagccttccagtcttggagctctgttgggtccagcagtccagccacataggggaggacagagatgacagcttagactagtagatgcgatggtgttcttccctgattcaggcagagcaaacaggcgaaaaccacagctaccttcttctctctgggaagggaaagaattggctgagaccctcagaatctctgaatgattggtgggggtcttctcatgtataagacaaggtcatgaagactgagaaaggcaccagtgcggaaagtcaaggaaaatgaaaactcaggcaaagatatttcaaagaaataaaacaaatctccagaaactgaccctagtgaaatgaagttatatgatttattcgacagagaattcaaaacaagggatatgaagatgccccctaaggtcaagagaacaatgaaggaacaaaatgagaatttaagtaaagtgacaggacatattttttaaatatgtgccaaacagaaattatggagctgaagaacataattgacctgaaaattttactggaaagattcaacaacagaccagatcaaacagaagaaagcatcggtgaactcaaagacaacatcgttacaaataattcaatcaggacagcaaaaaatagcaataaaaagagtgaagaaagcttacagaacttacgggaaatcaccaaacagatggggtttcaccatgttggccaggctgatcctgaactcctgacctcaagtgatctgcccacctcggcctcccaaagtgctgggattacagttgtgagccaccgcgcccggccaggtcacactctcttataatgactaatagaactagagtttaactgccaaaaatatagtttttttaaaaaaaagttaaacattttaaaagtcgaacactcattcctgcccctgatctttctctgtgctctacctcctgccagccatgccccctgggcacagccaattctgtcccacctctgacttcttcctgccactcactggggtctccagctgtcagcaggaccatcgtggggtcactccactaactggcctcccgcttcccatcttgaatccatacacactgtcctccacacaacagctcctggggtttctttttttttctttttttcttttttgagacaagatcttgctctgtcacccaggctggagtgcagggcgtcatctcagcccactgcagcctcaacctcccgggtgcaagcgattctcccacctcaacctcccgagtggctggtattacaggcacctgccatcacacctggctaatttttgtatttttaggagagacagggttttgccatgtttcccaggttttacgggctttttttaaatatatataaactttttattgacaaataacataaataacatacaaaagagaagaaacaataggttcccacctcaaaaatcctcccaaatactgaagtcaagaaataggtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaagaaataggtcattccggaagcccccagcgagctccccacccagttactcccttcttcccaaattcaccactaccctgcctattattattttttaactataaatatttatttagtagtctgaactaagtgctaaatgaaattgaaatgtattttattctttttttaatagtaatttttttttaattttattattattatactttaagttttagggtacatgtgcacaacgggcaggtttgttacatatgtatacatgtgccatgttggtgtgctgtacccattaactcgtcatttagcattaggtgtaacccctaatgctatccctcccctagctccccaccccccaacaggcccctgtgtgtgatattcccttccctgtgtccatgggttctcatcgttcatctcccacttatgagtggcaacatgcagtatttggttttctgttcctgtgttagtttgctgagaatgatggtttccagcttcatccatgtccctgcaaagaacatgaactcatccttttttatggctgcatagtattccatggtgtatatgtgccacattttctttatgcagtttatcattgatggtcatttgggttggttccaagtctttgctattgtgaatagtgctgcaataaacatacatgtgcatgtgtctttatagtagaatgatttgtaatcctttgggtatatacccagtaatgggattgctgggtcaaattgtatttccagttctagatccttgaggaatcaccacacggtcttccagaatggttgaactaacttatactcccaccaacagtgtaaaagcgttcctatttttccttatcatctccaacatctgttgtttcctggctttttaatgatcgtcattctaactggcatcagatggtatctcattatggttttgatttgcagttctctaatgaccagtgatgatgagctttttttcatatgtttgttggcctcataaatgtcttcttctgagaaatgcctgttcatatcgttcacccactttatgattgggttgttaggtttttttttcttgtaaatttgttaaagttccttgtagattctggatattagccctttgtcagatagatagattacaaacattttctcccattctgtaggttgcctgatagtttcatttgctgtgcagaagttatttactttcattagatcccatttgtcaattctggcttttgttgccattgctcttggtgttttagtcatgaagtctttaccagtgcctgtgtcctgaatggtattgcctaggttttcttctaggctttttatggttttaggtcttatgtttaagtcttttatccatcttgagttaattttagtataaggtgtaaggaaggagtccagtttcagttttctgcatatagctagccagttttcccaacagcatttattaaatatggaatcctttccccattgtttgtttttgtcaggtttgtcaaagatcagatggtcgtagatgtgtggtgttatttctgatgcctctgttctgttccattggcctatgtatctgttttgatactagtaccatcctgtttggttactgtggccttgtagtatagtttgaagtcagctggtgttctttgtcagctttgttctttttgcttaggattgtcttggctatatggactcttttttgattccatatgaaatttaaagtagttttttttttcctaattctgtgaagaaagtcaatgggagcttgatggggatagcatggaatctgtaaattactttgggcagtatggccattttcacaatattggttcttcctatccatgatcatggaatgtttttccatttatttgtgtcttctcttatttccttgagtggtggtttgtagttctccttgaagaggtccttcacatcccttgtaagttggattcctaggtattttattctctttgtagcaattgtgaatgagagttcactcatgatttggctctctgtttgtctgttattggtgtacaggaatgcttgtgatttttgcacattgattttgtatcccgagactttgctaaagttgcttatcggcttaaggagatttagggctgagacaatggggttttctacatatacaatcatgtcatctgcaaacagagagaatttgactttctcttttcctatttgaataccttttatttctttctcttgtctgattgtcctgaccagaacatccatcactatgttgaataggaatggtgagacagggcatccctgtcttgtgccagttttcaaagggaatgcttccagtttttgcccattcagtatgatattggctgtgggtttgtcataaatagctcttattgagatacttcacatcaatacctagtttattgagagcttttagcatgaagcagtgtcgaattttattgcaggccttctctacatctgttgagataatcatgtggtttttgtcattggttctgtttatgtgatagattatgtttactgatttgcatatgttgaaccagccttgcatcccagggatgaagccgacttgatcgtggtggataaactttttgatgtgctgctgtattcagtttgccagtattttattgaggatttctgcatccatgttcatcagggatataggcctgaagttttctgtttttgttgtgtctctgccaggttgtggtatcaggatgatgctggcctcataaaatgagttagagaggagtccgtctttttctattgtttggaataatttcagaaggaatggtaccagctcctctttgtacctctggtagaatttggctgtgaatccatctgatcctgggcttttttttgttggtaggctattaattactgcctcaatttcagaacttgttattggtgtattcagggatttgacttattcctcatttagtcttgggagggtgtatgtttccaggaatgtatcagtttcttctagattttctagtttatttgtgtagaggtgtttatagtgttctctgattgtagtttgtatttctgtgggatcagtggtgatctcccctttatcattttttattgtgtctatttgattgttctctgttttcttctttaatagtctgggtagtggtctatctattttgttaatcttttcaaaaaaccagcttctagattcattgattttttttgaagggtttttcatgtctctatctccttcagttcttctctaatctgagttatttcttgtcttatcttagcttttgaatttgtttgctcttgcttctctggtccttttaattgtgattttagggtgttgattttagatctttcccactttctcctgtgggcatttggtgctataaattttgctctaaacactgctttagctgtgtcccagagattctggtatgttgtgtctttgttattgttggttccaaagaacttatttatttttcccttaatttcgttatttacccagtagtcattcaggagcaagttgttcagtttccatgtagttgtgcagttttgagtgagattcttaatcctgagttctaatttgattgcactgtggtcggagagactgttatgatttccatccttttgcatttgctgaggagtgttttactcccaattatgtggtcagttttggaataagtgtgatatggtgctgagaagaatgtatattctgttgatttagggtggagagttatgtagatgtcaattgggtctgcttggtccagagctgaattgaagtcctgaatatcattgttaattttctgtctcattgatctaatattgacagtgaggtgtgaaagtctcccattattattgtatgggagtctaagtctctttgtaggtctctaagaacttgatttatgaatctgggtcctcctgtattgggtgctcctgtattgagtgcatatatatttaggatagttagctcttcttgttgcgttgatccctttacgattatgtgatgctcttctttgtctttttagatcgttgttgacttaaaatttgtcttatcagagactaggattgcaactcctgctttttttgctttccgtttgcttggtaaatattcctccatccctttattttgagcctatgtgtgtctttgtacatgagatgggtctcctgaatacagcatactaatgggccttgactgtatccaatttgccagtttgtgtcttttaactgggacatttagcctgtttacatttaacattaatattgttatatatgaatttgatcctgtcattatgatgctagccggttattttgcccattaattgatgcaatttcttcatagtgtcgatggtctttacaatttggtatgtttttgcagtggctggtaccggtttttgctttccatgtttagtggttccttcaggagctcttgtaaggcaggcctggtggtgataatatctcccagcatttgcttgtgtgtaaaggattttatttctccttcacttatgaagcttagtttggctggatatgaaaatctgggttgaaaattcttttttttaagaatgttgaatattggcacccaccctcttctagcttttagcgtgtctgcagagatatccactgttagtctaatgggcttccctttgtgggtaacctgacctttctctctggctgcccttatcattttttccttcatttcaaccttggtgaatccgacgattatgtgtcttggggttgctcttctcaaggagtaactttgtggtgttctctgtatttcctgaatttgattgttggcctttcttgctaggttggagaagttctcctggattatatcctgaagagtgttttccagcttggttccattctccccgtcactttcaggtacattaatctaatgtaggattggtcttttcacattgtcccatatttcttggaggctttgtttgttcctttttgttcttttttctccaatcttgtcttcacactttattttaataaggtgatgcttcaatttctgatatcctttcttcatttgattgattcagctattgatacttgtgtatgcttcacgaagttctcatgctgcgtttttcagctccatcaggtaatttatgttcttctctaaactggttattctagttagcaattcctgtaaccttttttcaaggttcttagcttccttgtgttgggttagaacatactcctttagcttggaggagtttattacccactttctgaaacctacttctataatttgccaaactcattctctgtccggttctgttcccttgctggtgaggagttgtgatcgtttggaggagaagaggctttctggtttttggaattttcaaccttgttgtgctggtttttcctcatcttcatggatttatctatctttgttctttgatgctggtgactttcggatagggttttggtgtagacgtcctttttattgatgttgatgctattactttctgtttgatagttttctttctaaccatcaggcccctcttctcaggtctgctggagtttgctagaggtccactccagaccctgtttgcctgggtatcaccagtggaggttgccgaacagcaaagattgctgcctgttccttcctctggaagcttcgtcccagagggactcctgccagatgccagccggagctctcctgtgtgatgtgtctgttgatccctgctgggagatgtctccccatcaggagacaagagggtcaggggcccacttgaggaggcactctgtgccttagcagagctcgagcgctgtgctgggagagctgctgctctcttcagagccgagaggcagaaacgtttacgtctgctgaagctgcacccacagccgccccttcccccgggtgctctgtcccagagagatgggagttttatctataagccctgactggggctgctgcctttctttcagagatgccctgcccagagagcagttttacaggctttttacagacagatcagaccgagtccctgaaaactccgtgacagatgtttgtcacattgaaagtaaaatggagcctctccgcctcggcccacaaacgtctccattatgagaccaagcctggtctgctcgttcaccactctggtctttaatttcctcaaatgctcagagctctctcgtagcttagggtctttggagttgctgtttcctctccctaaatggttcctctcaatccttgcataattagtcattgagatatcagcttaaatagcacctgttcagtgagacatttttttcaccaggcaatctgaggtagctatgtagtcacttttgatcctaaaaccttaatttaacagggtgtgtgtgtgtgtgtgtgtgtgtgtgtgtgtgtgatcagcccgtgctaccttcttgcttgtgggggcctctatccctcacgagctgtcagtcctgctgcctgctgcatcccagacttgggccatgcaagctgcattgaagcactcagcccacacttgtcaaatatgtgaatgagagagtgagtgaatgtatatgttcttaatgcccagcatcattcacaacacatattcgatattaatgtttgttgaatggcccaatatgacaagaggagtaaaagtgtttctagtaaacagtgtaagataatgttgttatttctaattaatgacattctagtagaaagtgtaagacagtgttgctgtttctaattaatggtgtgctctgatgaatcgatgtcactgaaatggggtctttctttaaaaatgcagacatgctttacagcctggctgcttcaaagttgggcattattaagaatctccagctttaacagtgaaaggcctattccacacagggaatatactgattcatgcagccatgttgcccagagctagccagggctggaggcccgaatccacggaggccgggccaggccaccccagcatcaggcctcaggcctgcccacctgcactggcttcattcagaccgtcccaggcaatgatgagatggcaccagctactccaggctgaccctctaccagctcagagaccaccaaggcagcaaggaagcccctccttcccaggagtgacagcagtttattcattcattcatttattcatcccacaagtgtctcttgagctcctccatgtgtcaggcactgctccagatgctccccaatgtcgtgggcatggcaggcagtgacagctctcatgcttcccatgctgtcacagaggaggacagataataagcagtaaacatgacaggtgatcagtaataaaaagtgaagtgtgtagcaccctaaaggtgtcgagtgccgcgagggaaaattcaacagaatgagggggtctgtaagggtggaaggctggctctcagttctgcagaggctggatagagtggaggctgggtctcagttctgcagaggctggttagagcggaggctgggtctgagttctgcagagcttggttagggtggaagctgggtctcagttctgcagaggctggttagagtggaggctgggtctcagttctccacaggctggttagagtggaggctgggtctcagttctacagaggctggttagagtggaggctgggtctcagttctgcagagctggttagagtggaggctgggtctcagttctacagaggctggttagagtggaggctgggtctcagttctgtagaggctggttagagtggaggatgggtctcagttctacagaggctggttagagtggaggctgggtctcagttccatagaggctggttagaatggaggctgggtctcagttctgtagaggctggttagagtggaggctgggtctcagttctacagaggctggttagagtggaggctgggtctcagttctgtagaggctggttagagtggaggatgggtctcagttccatagaggctggttagagtggagtctgggtctcagttctgcagagcttggttagggtggaaggtgggtctcagttctgcagaggctggttagagtggaggctgggtctcagttctgtagaggctggttagagtggaggctgggtcttcattcttttgggttgtgccagcaaggccatgacatctcctccacactgtgatgggctcagcatccagctcatagtagttggaacagtcagtatttctgtctcagggattatttatctaagggactggggctgaggagggatctgcaggcttctaaacctgaccacatcatcctccccatgcgtcctgctggcaggagaccaccgttcaatatttgaccacttaatatttggtgagattccatgcaaattactaaactcaagttgcctccgtatgaggagttttctgagtcctgcagctccaacccccacctccccacataccccagccaccgcgtcggcacctctcctcaagtcaagccagctgcggccacacatttccattctgatgcccaagacacagctgggacagaacacattcttaaagacacttaagtgaacaggcacaaagatgaatgacccttcttcattttgtggacactgcagacactgttcacatatggccgttatcgacatggattcagaaatcattttcctggaaacattgctaggtaactgcgggagaagggaccttgctataaatgcactggagtttgctgaaaatgtaaatacgaattttatctcctaacaccagggagagatgtttcactagggtgttcattatgatttgcaaatgaaatggacaaaattcagattctctaaacagtacctcagtggggcatcctatccctccatccaaatagatccatgtttctcaaagtgtggtctggcccatagaccaccaggaatggaatcacctagaatgtttatttaaaatttggatttggggctgacctcacccttctaaattccatctccggggatgcgatccaggaatcaacattacatgcaagcactcaggagatcgtgatacaggaatctatattacatgcaagcacacaggagaccgtgatcctggaatctatattacatactagcatgcggaagaccgtgatccaggaatctacattacatgcaagcacgcaggagactgtgatccagattgggatttgcaaaaccatccaatgaatgtcttcttgttgctccgacaccagcctttaaatgtaaagtgacaacagtcaaaaatatttataaagaaaaaagcaatgtacttgttaaaaaaaaaactcaaacataaatggcttagatgtaaataataatgaagataccacaggcagaatcatagcttctctgtgataggccagccgttagaatcgctgagcttagcatctaccaggagctgctgcagaaaaggtctgatgtcttgtgtcgtgtgtggagtacttgtggtgtaacaggataaagatagtgcagtcgctttgttgttagaagcaacagcaccagaagccaggcggggcacaccaccctgcagccaacctcggtgccatcggctcacctgacctcatcggcccctgaggatgcaggccaggcaccatcattgcttccactgccgaaagaggaaacagtgggtgagcaacatccgtgacttacccaggttcatacggtgaggatgcacagaaccgaatgcaagccccagatccggacctcctgacctccactcctgtgttctggacacagctccctactactcaggggagtggaccaatttgagccgaagatggttacctacttgattcgcacttccgtcgccacacaagtgatacagcagggctctcagagtgcgtgcctctgagatgcttgagaagcaaagtggtctccatattcccctgacgtcttctgttcgtgacttgaaggaagcagatgatcacaagagtctctggtgaatgcgtgaatccagggctctagtgagtgcggcctgtcctttgtgcatgagctttagaaacgtgctacattcttgtgggcctaagtgcctctttaggatgaaatcttttcaattagcaatcaaagacttttataccctgcccctttccatggttgtcccctccagcaaatctgtgatcccgctgatgttaccttccctgttataaggaagaaaacagagaatgcagcgtttgctaactgtccgagcccacagcgtccatgatggggtgagaaccgaagccagcagctccccactctggaagtaaactgttgactcatttccgtgtttgtctgaattattagtttatcatatagttgtaataatccatggcaaatgtttaaaatatgccacaaaagcaacacatgccaaatttggaatcagaaggtcttcaggctcaaatctcagctcgagctcgtgctgtagaacgtgtcacctctgagtgaagactttctcttcttgttaaagcaaggttaattataataccttccgcagagaatcataaccagcaccaaatcagaggcgaagaatgaaagtatttgtggaaaatgaattatcgttaactctgctgccccagagctccctcactgtccttccttgaggcccaagagaaaagacgaactgaaggtaccagtgggttttttttgaaaatttgcttcaagtctacattctgaacgtacggttcatttcaactttcagatgacataaagctaaatagagtgctcttcgtatcttattttcctcctttattgagttatgatttaagaaccatacaattcatccacttgaagtacaattcagtggttcttagtttatttatggacttgcgcgaacatcagtgcaatccattttagaacataaactttacaccaaaaagaaaccctgtaccgtcactccccacttcccctaactcctccaacccctggcaaccacgaacctgcattctccctgtcgtggccatggaaccccacaatactgtatctttgtgtctggcttctagcataacgttttcaacattgatccacattgcagcatgtgtcagaactgcaattctttttatgatggaagcatattccattgtatggatagaccacagtttatttacccatccatcatggatgtatacttaggttgtttccttttggaggctattatgaataattctgctatgaccattattctgtttgttttctgagatgaggtctcactctgttgcccaggctggagtgcagtggcacaatctcggctcactacaacctccgccccctgagctcaaggaatcctccctcctcagtgaccccaagtagctgggtccacagatgtacaccaccacacccagctaagtttttgtatttttggtagagacgagatttcatcatgttgcccaggctagtctcaaactcctaagctcgagagatccacctaccgcagcctcccaaagtgctgggattacaggcgtgagccacagcacccggcctcctgtatgagttttatgtggacacacattttcatttctcctgggcatataccaaggagtggagatgctgggtccttgataactcaatgtttgaccttttgaggaactcccagactgtttttcaaagtggctgtactacatataatattaaataacataaattagttgcatatgtaacattatattattgtattgttttcatatacatatgtttatataaaaattatccatcattctttaaaatctgacttatattctttaatctctaaagatttacagagacacagttttatagcaagagcagatttttcatctatcttaaaatgtgtatgttcatcagtatggatatactgacacccatatcctggaggacaaatgattggaggatttccataatgctcatcacatctgttctgacgtttaagtcactgtcctttctcaaaggaaatctaatttatactccttagcacaatattgctatcttttcttagaaatacatttcacagttgaaatataaagcaatttgaggaaaataagatttttagaaagacatcgggcctgtgtaaatatatcctttagaaaattgacttcagagcgtgagcgacgcagaagacgggtgatttctgcatttccatctgaggtaccgggttcatctcactagggagtgccagacagtgggcgcaggccagtgggtgcgcgcaccgggcgcgagccgaagcagggcgaggcattgcctcacctgggaagcgcaaggggtcagggagttccctttctgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcggactgcctcctcaagtgggtccctgacccctgacccccgagcagcctaactgggaggcaccccccagcaggggcacactgacacctcacacggcagggtattccaacagacctgcagctgagggtgctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagtggaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcagtggaagatgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatggggcgaatggaaccaagttggaaaacactctacaggatattatccaggagaacttccccaatctagcaaggcaggccaacattcagattcaggaaatacagagaacgccacaaagatactcctcgagaagagcaactccaagacacataattgtcagattcaccaaaatggaaatgaaggaaaaaatgttaagggcagccagagagaaaggtcgggttaccctcaaagggaagcccatcagactaacagcggatctctcggcagaaaccctacaagccagaagagagtgggggccaatattcaacattcttgaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacgaccggtaccagctgctgcaaaatcatgccaaaatgtaaagaccatcgagactaggaagaaactgcatcaactaacgagcaaaatcaccagctaacaacataatgacaggatcaaattcacacataatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacgggagcacccagattcataaagcaagtcctgagtgacctacaaagagacttagactcccacacattaataatgggagactttaacaccccactgtcaacattagacagatcaacgagacagaaagttaacaaggatacccaggaattgaactcagctctgtaccaagcggacctaatagacatctacagaactctccaccccaaatcaacagaatatacatttttttcagcaccacaccacacctattccaaaattgaccacatagttggaagtaaagctctcctcagcaaatgtgaaagaacagaaattataacaaactatctctcagaccacagtgcaatgaaactagaactcaggattaagaatctcactcaaaactgctcaactacatggaaactaaacaacctgctcctgaatgactactgggtacataacgaaatgaaggcagaaataaagatgttctttgaaaccaacgagaacaaagacacaacaaaccagaatctctgggacgcattcaaagcagtgtgtagagggaaatttatagcactgaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaattaataaattgctcgacacatacactgtcccaagactaaaccaggaagaagttgaatctctgaatagaccaataacaggagctgaaattgtggcaataatcaatagtttaccaaccaaaaagagtccaggacaagatggattcacagccgaattctaccagaggtacaaggaggaactggtaccattccttctgaaactattccaatcaatagaaaaagaggaaatcctccctaactcattttatgaggccagcatcattctgataccaaagccgggcagagacacaaccaaaaaagagaattttagaccaatatccttgatgaacatcgatgcaaaaatcctcaataaaatactggcaaaccgaatccagcagcacatcaaaaagcttatccaccatgatcaagtgggcttcttccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccaggacaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccagaacaccaaaagcaatggcaaccaaagccaaaattgacaaatgggatctaattaaactaaagagcttctgaacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggagaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaactgaacaattagaacacgtggacacaggaaggggaacatcacactctggggactgtggtggggtggggggagcggggagggatagaattgggagatatacctaaggctagatgacgagttagtgggtgcagcgcaccagcatggcacatgtatacatatgtaactaacctgcacaatgtgcacatgtaccctaaaacttaaagtataataaaaaaaaaaaaagaaaagaaaagaaaattgacttcaactgaaatttatgcactgcgcacccagctccatgaggacaagggcgatgccttcataaatgatgcccagaaagtatttgatagatgagtaactcattttctaaattaacatattttgggagagtagtttaacagcagcagtaaagccctttttcgagaacctgttctgtactgcttcggacagatgtaggtctccattctgaattcatgtccaccctgcatgttcagttcactcacactggcctcctctgtattctttttggaaaaatcatagagaaagattagcaaattgaattttttaaaaataagcctcaaaaatgttgaatgccaaaggactaaattgctaccttccattctagctctatcaactattcccggtacaaatatgaacagtaaggccaggctttgcaatgcgtgacctgacaggtctcagactcggcggggttttcagcgaaaatgggcctcaggaggcctttggaagagccaggtgggggaggctggttcactgcaagtgtatgccctggcttcagcggtgactgagccctcgtagcccaggggacatggtggatcatcacatacttctcatgggatccttcacaaaccccaccagcaccttcagcagatggagaaatcaactcttcacaggcagaaaaaaaacggatggcacagacctggggtctcctgagcatttgcagtcaggcaagagaacagccgtggggcctctgcagccagagggtgaatctcacctcagaactgactcagtgaacacggaattaccagccacattggcagagacctcacagtcagtgctgctggtaccacaggcaggacaaggggtgccgaggttggaatatgaccacagacacccggcggactggaggtggcctctgccgcagctgccattgacggcttggaccccgctttgtgttgccagcatcacctccaggtgtgcagaaaacatgacttaccggacgaccttgtgcccacacgagctccggggactctgggaaaggagacctcccaggcggagccccctgtggcacagcctctgcctctgcagtgctgggctccccaaaccaacaactacagcagcagaactgatatgcaggttggccaagccaaggacagttgctcaccctggcgacacgattttttaaaatgtaataatggggagttctggctctgggataataacttatattgaagaaacactcatacagatgacagccatgaactgtggagcccacacacacatgcattgcacgtgcacacacgtgcacacgcacacacacacacgcatgccctcctgtttgaaagcagagttgggcaggaagtagagactattcacattttaaaggaaaggcgccgcgctcactcgcggctgcccatggtcctgtgagttccctctgagcaccctcgctacctgctgcaggagggcggtaggaactgaagcagacagctgcagtctccttggatgtgtctgttacaggatggaatttggggttgccagaagaggtgggggtcagaacagaagggatggagccatggagggagaccccaaagtctattaacatttgcggacccctgaaaaagtttagtttccagctgctgaccaccgatggtgaagatcagtctggaggctgaaccccaccaagtgcacaggccaggtaaaccatctgcagcctccccaggcccaccccagcaacgcacgagccaaacacccaaagctaaggaggatcggccacaaccaaaattagcacacattggaggagggagcaggtgccggggtctctgccagtcgtgtcctttatgccgaaaagaggctgaagttgtagcaacatgaaacccacctgcaaggaaaaaactgatgtgctcaaaacgaagcctgagaagaccccgatggtagaactcaccagaaagatctttaaacagccattgtaaggtcttatgaatgatataaaaatgttagaactcaccggaaagatctttaaagcagccattgtaaggtcttatgaatgatacaaaaatgttagaattcaccggaaagatctttaaacagccattgtagtcttatgaatgatataaaaatgttagaactcaccggaaagatctttaaacagccattgtaaggtcttatgaatgatataaaaatgttagaactcaccggaaagatctttaaagcagccattgtaaggtcttatgaatgacataaaaatattagaattcaccagaaagatctttaaagcagccattgtaaggtcttatgaatgatataaaaatgttagaactcaccagaaagatctttaaacagccattgtaaggtcttatgaatgatataaaaatgttagaactcaccacaaagatctttaaagcagccgttgtaaggtcttatgaatgatataaaaatgtctgttacaaggttaaagatgttaaaggagaagaaggtcttaatgcctgactagatggagaaatgaaatccatgagaaagagacaaattgaattttcaagaacagaaaaccacaatatctgaaatgaaaaatttatgggatgtgtttaagagcgaattgagagagcaggaaaaaagcttagtaatttgaaaatgaaacagtagatattctcaaatatgaaaaagtagaggtaagatattaaaaaaaagaatagagcctcagtaatatgtgtagtaagaagaagtgaagggacacacatataattagagaaccagggagaaaactgagagaatttggcagaaggttttgaagaaaaaatggccaaatattttacaaatttggtttgaaagaatccacagacccaaaatgctcagtgaactctaagaagataaatagaaaaaaatcatacctagccacaaaatagttaaactgtggaaaaccagagagagacaagtctgtaaagcaaccaaggaaggggtcaaacagaaaccagaggaataattagaaaattatgactgccttattgtcagaagcaatgggagccagaagacaatggaatcatacctttaaagtgatcaaaaacatctattgattcagaatactatacccagcaaaaatatcttttaaaaaatgagagcaaaataaagacttttcaaacagaagctaaggaatctatttttaacttaaatacatgtatccacatgtggctacttttttatctttcatttagtttcaggggtacatgcacagatttgtgatttaggtaaactcacgtcatgtggggtttggtgtacagattatttcgtcatccaggtaataagcattgcacctaataggtatttttttctgatcctctccctccttctaacctccaggaggccccagtatgtgtagttttcctctctgtgtccatgtgttctcatcacttagctcccacttataagggagaacatgcagtatttggttttctgtccctgtgttagtttgctaaggataatggcctccagctccatccatgttgctgcaaaggacatgatctcattcttttttatggctgcatagtattccacggtgtacatgcaccacattttctttatctgtctaccattgatgggcatttaggttgattccatgtttttgctatagtgaatagtgctgcaatgaatgtgcatgtgttttaatggtagaatgagttctcttcctttgtgtgtatacacaataatgggattgctgggtcagatggtagttctgtttttagttctttgaggatttgccactctgctttccccaatggttgaactaatttatgctcccaccagcagtgtatgagcattcccttttcttcacagcctcacagcatctgttgtttgtccactttttagtaatagccattctgatgggtgtgagatactatcttattggggttttgatttgcatttctttaatgatccatgatgttgagcattttttcatgtgcttgttggccacatgtatgtcttcgtttgaaaagtgtctgttcatgttctttgcccacattgttttttgcttgcaaatttgtttaagttccttatagatgctgggtattagacctttgttggatgcatagtttggaaatattttctcccattttgtacgttttctgtttactctgtcgatagtttcttttgctgtgcagaagctcttaagtttaattagatcccattatctaccataatggacagcgcacctctagagcaaccactcaaatattaacgctatgcattacagccaatacgagctaaagctcaatgttaaaaatatttgattaacccaaaagaaagcaaaaagaaatcagaggaacaagtatatgaataggacatatggaaaacaacagtaaaatggtaggcttcaacccagtcataataatacgtgtactaaagtaagtggaataagtaagtaaaaggctacagttctaaccctggggaaaaaatgtcaacattaagggtgcaacatttaactccctccgtaagatgagataaaacacgaggatgccgactctcagctcctctacttaacattctaatggaggtcctcgccagacacagaaggcaaacaagaagagaaaaagcacgaaatttaaaaggaaggagctccttccatgtttaggttccaggtttattcttatatcacatgattgtttacatagaaaacctaaggaaactacaaatcaaatcctggaacagatcatgccattcatcaaggctaggacatgaatgaaataggtagaaatcaattgcatttctgtagacccataatgaataattggaaaatgcagttagttttaaacatctcaacagcattgtagaattgtggtgctctaagatagaccatctaaataaatcgagagctagactgtgatgcattggaagtctcagtaatgtgaagatgtgaaatctccccagactgaggtatggattcagtgcaacctcagtagaatcaatgtcattcaaagcaacctcagtttttagagaaactgacaagaagattctaaaatgtgtgaaaatgtgaagaacctagaagtgccaagacagtcttgataaaaaagaacacagttggaggactcacgctatctgatttcaagacttgcgttaaatctaatcgggacagtgtgatattcatataagaatagaaaagggtctctcagcctcagcactcttgatatttggggccagacaattgtctctcattggggggatctccgtgcaccttcagcattcttgatatttggggccagacgattctctcttgttgggggccctctgtgcactgtaggatcttttcatggcatctctggcacctgtccagtagacacgagtagcaccctcctctaaattgtggcaaactcaaaatatctccatacatcaccagatgtcccttgagggcctaatcgccccagattaagaactactcaaatagacaaaatagatccgtgtgacagaatagagactccagccgtcaaaatctttaaattctgttcattaaaagacacaactaagaaaatggaaaggcaagccatagaataagggaaatgtctgtctgacaaagggcttgaatgcagaatatgtcaagaactcctacaaaacaagaacgtaaagacaaccccagaaaaatgggcataaaagccaaaaggttactttgcaaaagaagatacacaaatgtccaataagaattagtcatccaggaggtgaaagtgaaaactttattgggatacacttcaatttcactagaatggcctaagttaaaaagaatgacaatacaacatgcccaagaggatacgggtggaggccacagtcaacatctgtcaaaactcactgagtcctacaagtgagacctgtgcctttcactgtctatcaattttctctcaattaatacaatttaatgggtatatatttttctgtttcatttctatgtaagaaagaaaaataaattttttggtaagtttaccttgttcttttaagaaaaatttaaacagttgaaatattttcttcagaccagttgtttctgagacatctaccaaatgctaaaatctcgagtcacaatacaggtcttgcaaggacaagttaaacatagtatgtgttaacattaagtaagtgctcaccatgtattatacttgtattgcatgtaacattcttaccttatattcacagaactccataagttatgtcctgtgactactgtcctcattgtacgttgcatagattaagagatttgtccaaatgacaccgttggcgagaggttgagccaggatctcaatgtgggctttcaggcatcaacacatgtgctccactgtgcatacaaactgccttctgcgcaccatgttacttccgacctgtaaagcacatttcacggccaagcacactgttggcctcagcatagcgtttcctgtagacaggaaaaatgatcccaggcccgcctctttgagtgtctttcccatggtgtcttattttcaccttctaaaaataaatgttcacgttgcttcatccccccatccaagaaaactcacagcctttctcaaatcgcctgtcctctctgctgttcctgacaagttgttcaaaagttccactcatacttccattttcttaccttaacgtctgcgatctcatttctgcacccatatccactgaaactgtcctttttaaaaatgaccccagcttgctgcatctgacggtctttccccatctcattccacttgatttctcagcatctgctccggggccgggctcctcctgtccctcgggtgcccaggagcgtcccccgccccacgcccctctcactttcctcctggattcccttcgtggccccgcctcacctgagaggcctcctccacctttctgctgcgtgacactcacagcccgacgtcttccacacttttacatctgaagcactcagaggttcacagccctgcccgtcacacttgctctgttctttcacagacttcttggaagtgccctagaatcagcaggtccaaatcaaactcaggtccaacctccaaaacctgtttttcttcctatcatagatcttgcctttgttgggagaagtctaggcgccttggaatcatctcacctctaacacattcctcattcctgtgggctctgtccctaaaatccaagccctttggtgtctcatgagaaaccagctcaagtctgcaggagcctctcggggtctgtgtccaggacaccacttcctgcattcaggcacctcgtcctccaggccccacgcacagggaccgtcctgagctcccagctcacaagtccctgattaagaacttgcagtacttttcttttgcctgtggcataaacatcaagctgtctggggtgtccctcacagtttcccactctgcttccccaaacttctctcccagaatgcctttccccctttaccctctgctctccagacaaacaatgctcactccccgcctcccagctggcacacactctacatttccttttagcattttgcattaagaaatctatgttccagtctttgtccccaacacactgtcaactacacgagtgctacgcttgccatcttgcagaaggcctttcttgcacttccaagcacccagacttacgtgggaggtgccttattaagatgccttctcctcgtgttctgtttgggaagcctttggtggcacatccttcaaacctgcccagtcctggttatagcaaaggacgggtagagccaagtggacgagagccggaggtggttggtccggctgggtcagggtcagctgcactgggaccagggcagaggagagccagaggaggttgtccacactgggttggggtcagctacacgaggaccagggcaaaggaggttgtcatggctgggtcactgttagctgcactgggaccagggcagaggagagccagaagaggttgtccacaccgggttggggtcagccccgttgggacccaagccagcgtcatgcatctgagcatgctggctctcactctcagctggccgtgggtcagccattgcagccccacctgccacgggctccaggaagagcagtcatcagtatggagaaggccggactctgctcagaagccactgagcaggtgctccatagactcaccagctggagcggggtcacatctcggaggcaccgtcagcaccaggagggcagccaagcaagggtatggcatttccgagcctctgcggtcaagggtatcgcatttccgagcctctgcggtcaagggtatggcgtttccgagcctctgcggtcaagggtatggcgtttccgagcctctgcagtcaagagcccagagatgggttgtcggggcagctgtgggggcatcccagatgtgggtgccaacagtgagatgcaaatgtggatttccctcaaaaatgtgctgttagggaacaagcatgccttcatctcctgcaagggcacagaaagctcaagaacactttttaccctgaatgtggaaatgatctggaaagaagccattttctgaaatccagtcattaattgtgatattatttgaaatgtatactgaaaggtgttctaagaatttccattttgcaggtggaataatacacacatgtgcacgcacagcacacgcacgcgtgtgcacacgaatgtctgtttcactagcactgtttagcgtgctccattttccattgaatgcagtggaagaaacacttcttatatttgggagcttctcctgtcagatcccatttatagaaatgagaagatgatctctgtatttcaaatgaacacatttagtatggaaaaaaattttcttaaatatctccttagcacaacctgcatagaatccttactgctttccaaggtaacaagggagatggtttacgttgtgtattttcaagcatgtttagatggatctaaacagctggggtcagaggccctttcaggggtaccctttgttatgtatattcgttctcataatgacctaagtcacagaggaggttctgagcccaggattcagcaagcagctctggaaccattcgcaaagggcgagaacaaggttgaacaccaggaatcctgcagttctgtcttggggttatggattcacttgcacagctttccgtctcgcctgtttgtggatgacaatctaaggggagcaacatctgaaaggcaaaactagaacaaaaacatttctgtgttattctagaaaacttttcactatttaaaaaaaaattctgagctactaagtccatatagcaaaatatgtttccatttctgacacctgggatgccgcaggaattaccacttagagagataaccaaaggggctgaaagtcaacttcaaaatgccccgggatgtaggagggggattttcagggggaagagtcaggtggattttgtggagtgagccgtgctggggacttcaccctgtgtcacctggcggggccaccggagggtgcatccccccatcttgattggctccccctagtcctagttcttgagttttgatctgtgactgtgaggaacctggccttctgggactctatatgataaaatgctaagccattataatattttttaaaaagcctcttaagccaaatgaggctgaggttttatttgttattttttaactatttaaaaagtctgtggtatcagaggatgggatctttggctctgtggtcctatgactcagcatcttgagtgcttaaaatcccagtgaccttgggattttaaagcatgaattccagagccaggccacctggactcagaagggagtgctgcccccatcccgcccaagcctgagtgcatgacctggcaccagtgtgtgatgacctggcaccagtgtgtgaagacctgtgcgtgatgacctggaaccagtgcgtgatgacctgacaccagtgtgtgatgacctggcaccagtgcttgatgacctgacaccagtgcatcatgacctgacaccagcgcgcaatgacctgacaccagtgcacgatgacctggcaccagtgcgtgatgacctgacaccagtgcgtcatgacctgacaccagtgcgtgataacctggcaccagtgcgtgatgacctgacaccagtgtgtgatgacctggcaccagtgtgcgatgacgtggccccagtgtgccatgacctggcaccagtgtgtgatgacctgacaccagtgtgtgatgacctggcaccagtgcacaatgaccttgcagcaatgtgcgtctgatgctgcattcataggaggaaggttgggaagaggcctggtttataggactaatgtaaacattaaatgtgttaggacaatgcaaaacacttattagcatttctggcgtaatcttgcatagaaaatgttagctattgtgagtctatgttttaaaaaaaattattagctttcttcagcggcaacatttatgtgtcacactccattttgaaataaagagaatcattgagagaatatgtatttgaaacatagactcacaaaatacatggatccacctgtgagggctgtccagcagccactgccagagtgatgagccatggctcagaggtgatcccttcgttcacgtagcaggcactggttagaaactgtggacaccagatccagaggacgagaatccttcttttatgttttctcagtctagaaggcagcttcaatttgagaatgttaaaatgcaaaacggtggtgttaatcagaaggaacggctgttgtattggaagaaaattggtaattggtagaaagtgccgattggtagaaatggagggtatgaaaccagcaatctcaaggaagcatggaaggagagcagaagtgcgggaagtttacatttctgcaaagacaaaggtgagtcaagttaagagcctcagtcagggctcttggcatccacctgaggccacactgctcgggctccatagctcggggcttcgtccgctgcacatgactctgtattaaacacgcacaggcacgtggacacattcaaaggaagccagcagtggtctcttacagaatgagtccacgcatccatcaacctgagcctgaaacttgtgaccgtgtctcaggatgctgttgacattttgccgctctgttgaacccatgctttcagggtggtgacagccaaggtcagggatccgtgttagctcgccttctgttcactggcagtcgacctgggggatccacagaggaggggaggggacagggcccctgctggtgctggtgccggtccccacatctgcagcagagctgcccgtcccactgcccaggtgcagcgggagtcggcgggcatcgatgtgaagactgtgtgcttcatacccagtaaaattagaatcagctcaaaactaatttcctccctttgctttctctctctctctctctctctctgtctctctctctctctctttcctttttttggtctaagtcagggaggggaaggtaggtaggagctgctatatgttatacattttcttttaaagcaaaaatatttagcagaaagaatgactttaaatctataatgaataagcttcacttaataagaattcattgagtccagttttttttctctgatattccatttttaaagactgaagtaaatcagagaaaaaccacaccaagggtttactttgaaaagaaagtgtgtgctttaatgcccaactctggagtcagaatcgtccacctaacatctatagacatttttatgtacctgcttgtgcactgatatttaatgttcctattatcatccaaaacaggcaagaagaataattaatcatttctgtccacatttctacagcttttgataaaataaaatgaattttactgcactgtggaaagattgtcaataaaactggaaagtggtccagttagccagaagtttaagctaagccagacctttcatcggccaaacactcacagggttcttccatgcttttaacatttcacaaaacggcgagaaggaagaccagagaacattgatttattttaagggagtttggaagaaaacgaccgttgtgcttataaaatggttttcatttagcctactcctcctattatatttgctgatattgcataacctggacaactttgcataagttaaaactgaaagtgagccttgtattttttctgttattttttaaatatgtaaagttgccagagagccaataatttttatgagactctcagttttttggcttaaattcaggagctgagtttgctattatgctgtgtgagttactagtgcttacagcacttttttaaaaatatggaatgacccaaatttcactacctggccataaaatctcaggtttcaaaggcaattttgtaaatagcctcccctattacttttgatgaaattcacattcataaatatgaatctcagaatatttgcatatggcaaagttactcatcaagacacagacattcagttggaaatgtgatgctagcctctgggtgtggattggacggtcgttcccatctctggcctgtggcgggtgctcagcctctgggtgtgggttggacggctgttcccatctctaccctgtggcgggtgctcagcctctgggtgtgggttggatggctttcccatctctggcctgtggcgggtgctcagcctctgggtgtgggttggacggctgttcccacctctgccctgtggcgggtgctcagcctctgggtgtgggttggacggctgttcccatctctaccctgtggcgggtgctcagcctctgggtgtgggttggacggctgttcccatctctaccctgcagcgggtgctcaccctctgggtgtgggttggacggctgttcccatctctgccctgtggtgggtgctcagcctctgggtgtgggttggacggctgttcccatctctaccctgcagcaggtgctcagcctctgggtgtgggttggacggctgttcccatctctaccctgcagcgggtgctcaccctctgggtgtgggttggacggctgttcccatctgtaccctgtggtgggtgctcagcctctgggtgtgggttggacggtcgttcccatctctaccctgcagcaggtgctcagcctctgggtgtgggttggacggctgttcccatctctaccctgcagcaggtgctcagcctctgggtgtgggttggacggtcgttcccacctctgccctgtggtgggtgctcagcctctgggtgtgggttggatggtcattcccacctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtcagggtcccttcgccctttctccctggggtccagtctccccagccaggctggcacggaggccccggccgcataggtggcgatggcgctgccctcctggtcagcagcacttgggcaaggctacaccaaagggggttcccctggaattagctctggctgattagactcgtggacttactgttatatttttgacgtgtataactccatatcatttttgcgttgatttttttctgaggaagcaatgaccaaaagggtggtcatcctggcctctcttgttgataaagcacaggctgtcttccttcttcccaggctatttttccagtaaaagggggccagggaaaggctctggcagcatggctctcagctctgtcctctgaattgtgcctcagaaagtcctgtgagaggatagcctggtgtcgctcacagagtcctgccggtcggccccactcccagggcaggactgatttcgggacaggcacagtggccaggagaagggtccctgggcaccacgggaggggtggtattaaaatcaggtgcctgagacacgggggctgtgaaagggaggcccccctgctccccacctgtggtggacgggcctgagaacgcacagtgaaaaaatcggcaagtgtccttcagtctaatcatcctatattacatggcaaagaagaatcgaaagtttatcattttaattaagcacgttgcttactcacttaaatgcctttgaaaacagtgcttgagctgaccttgagtttgtatacctaacaaacattttctcttagtgtggagtagggattaagagcctgagccgacctcacattctctctgacttactgtggagtagggattaagatcttgagccgacctcacattctctctgacttactgtggagcagggattaagagcctgagccgacctcacattctctctgacttactgtggagcagggattaagagcctgagccgacctcacattctgtctgacttactgtggagcaggaattaagagcttgagccgacctcacattctttctgacttactgtggagcagggattaagagcctgagctgacctcacattctctctgacttactgtggagcagggattaagagcttgagccgacctcacattctgtctgacttactgtggagcagggattaagagcttgagccaacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctttctgacttactgtggagcagggattaagagcctgagctgacctcacattctctctgacttactgtggagcaggaattaagagcttgagccgagctcacattctctctgacttactgtggagcagggattaagagcttgagccaacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctgtctgacttactgtggagcagggattaagagcttgagccgacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctctctgacttactgtggagcagggattaagagcctgagcgcagggattaagagcctgagccgacctcacattctctctgacttactgtggagtagggattattctgggcttctgggccaaggcctgggctttctgtgccctcccattatgcagttatcggcgtgacaatggaagtacacagtcaattttagatgctattaggcaaagagtccagcatatactgagcactcaaaaatgatagcccttattattaccatgataacaataagtaatactatataattctgggcactaaagccctcctggctgcagatcatgctgtgagctcttggtagcttgcctggggctcagtaagcacaagtctttcttttgccgcagactttaaattcctcatgaggtagagtctattcattttgcaggttttttcctcatcggaaggttgtacccaggactttttccactgaactattgaggcttttcctattgcacaactcaagaaggataccacctcttttatctactcggttacttctttccttccagaaatggaattaagttctcatctgcatcaggaattgcattgactctttttcccaatgacaaggaaagaccgtccctagccctgcgctcaagtcctgggcaaatgggaatggtgggtcctccagccccctgctcccagccagccccctgcaaacaataacatcaactgatcctccccaactagataattgtaattattttaataactgaggaaacattctatttcagcataaagtccaagatgatatggggagacactaattaactaaacagagtaactgaaagtcagtgatacattttaacaacttgctccatacacagagatgaggatacagcagactttcttcttttaaagctatcaccttccctttcagtggatataacctagtttaccaaaatacagctttaaaaatccgatgtaacccaacaaaaggtttaaacagaagtgcaaagttatctcatccgaggtgtgaacgttcatctctaatacttttccacaaacaactttcaattaaatggatctcacacctctttaaatgctcttatgaaacattcagaggctctttgcgactcgtcgtcctgtttgggggtaaatgtaagctaaatatactagttctctcgtcatcttgcttttgatgaacccaagatggtatctaccaaaataagtcagtgaaaataacattttctcacatctttgtctatctgaaaggattcatcattggaaacaatggttaagcagacaagttgggtgcttgggggtttatttaacgaccttgaaatttagaattctaagtcattcctatgcagagttctatggcattactttaaattgaactcagttttgaattctcaggaaaaaaaaaagtgttattcaaaataatcctggaatgctggtagtaagtgagactgtatcacacccagaaacaaacgtagtaggtgagaagactgtgtcacacccagaaacaaacttccactaattgattgtccagccctaggccacgagacctgacaattctggaaggaaggggacagtgcccatggttgagggtgggacatctggaattactaacacttaggggctctggagagatgtgaatttggtgacaaaccaaagtttgttgaaagtttgcccttggccagtcgcggtggctcacgcctgtaatcccagcactttgggaggccgaggtgggtggatcacgaggtcaggagatcgagaccatcctggctaacatggtgaaacctcgtctctactaaaaatacaaaaaattagctgggcatggtagcgggcacctgtggtcccagctactcgggaggccgaggcaggagaatggcgtgaatccgggaggtggagcttgcagtgagccgagatcacgccactgcactccagcctgggcgacagagcgagactccatctcgaaaaaaaaaaaaaagtttgcccttcatgtttaacattcaattttttctcaagcacaggaagggaattaaaaatctaactgaagtcttgtgagaggtgcttatgtccatgccgtttcctccttggaacctcagtagctgcactctgcttgggtttcctgcagctcatgtcccgagggtctcggcgggaggtccgggtgtcccgagggtctgggcgggaggtccgggtgtcccgagggtctcggcgggaggtcccagtgtcccgagggtctcggcgggaggtccgggtgtcccgagggtctcggcgggaggtccgggtgtcccgagggtctgggcgggaggtccgggtgccccaagggtctgggcgggaggtccgggtgaacagatcattttaattccctgctggaccatcttgagatgctgctcaaccactttttatttgttttggggaggaggagtcaccttcatgtctagaacctcactgaaaggcttgtagctggaagcatagccgagggtccttgctgagatgccagcttctgtttgtgaaatgcacataccaggttaatggtgtctcttctttaggagcgagggcagctgggccctgggtcgggcttacagaagggtgtccactgaggtgtactagggcctcacacaggttctgaccttctcacgctgtctacgatacatctttgacaggaatgacacaatctaagacttttccataaaattctacataagtgaaaacttacattggaagaaatttatggtccagaaaaacatcctgtttccaagccagtgtgcatgcttctgagccctttgctgggttcctgaggccatcctgccggctgtgtcctggttgtgcctgcctgggtttgtctgtctctgtccagtgtcaggaatcctcagacctttctgaaaaaggccaccccgccggcattgtgccaactctttctgcagcctggcatgggtctgtcttccctgcagggtggcttcaggctttgctgccctttgctcaccccctgcctctccagggtccatgctgagttaggctcacgaggaaagaggccgtccttccagcacgtaggtcacctcaggtgaaaccagagaagtccacaggtctgaacttggagacaggcaaccagtgtcgtgttgtgtcaacaacacaactgctagagggagaacctgattctttgaccttgccttttactctgctgacaactaaaggaaaagaactaatctggtgtttaaaacagtgtatttttacaatgtatctgccaacataatccagggggttcagaaagctgttggtgctttgagctgtcacacatccccaggagaaacaagaagagaaataatctgaatgggagggggtgaggggagaaagagagacaggggaggaaggatggaagggagggaggatgggagggaggggaaaatgaagtgagtatactaatatcctaagctaaggaagaataaaaaaagcctggaatttaggtaaagtagcacatttcatgtggacgaaaacaccagtacagccatttctttctcatctggactcagatatatgctgccgtaatggggataaggagatgagtttagaagccaaatttgtgatgagttgccatggcaatgggtagaagcagactccatattctgaaaaagaactgagtagtgtatgcactgaatgtgctttcccttatacggcctcagtgcctggagccatcgtgccattagtagcttggaaagggggggccgtcatgtgggaaagggaaggaagaaatggattctgaacccttcctttgtaccaggtactttgctaatcttttaaaagttctatctctcttacactttgtaataactgtcagccttaccttgaaggtttgccttgcggtcccccagaatttcatcaacacttggaattggctgtttgcctaagtgtttcgtaagggaaaacccaatgctgtatttcccaagctcagccgatgcccatgctgacttcaggttaactgtgctgaactatgaggcagtgaaaggcagcctgggaatgagcgcgctctcctggcttttctgtaacgtgatggtgaccctggagggccggggcatcacgtgtgctgttgatgattgcaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcaggtaaggggacgccattttcagccttccagcggggactctagaggcatacctgtcttcatcctagaaggagcgagcagcacacagcaccacagtacaatgtactctcctgacatctagtaacgtttcctaattgcatgtgttacactgtcacattcgcaagggtgttttgtctcttgtagataacctttctttttcttagaatgaaatctactcattagcaagtttccttaaaataatcaagtgtaacttgtgtaaagttttagagaggagaaagaaatggaagtgctagcatttggaaggtgattaagttttaaataccaaagtttaatggattgcagtgagatttctgctgatgcgcagtgactctcaggctgccctgtagtgacgtccagccggtctcttgctcagtaagcagatctgtaaacatgactcaccgccgctaagcaggtccatcattaatgcagatgcactaactatcttagagctccgaagactcagtctcgcaatttcctttagttctcatggaaaaccatacccacccctttgaaaatttaccgcccaacctaaatatcactgcctaatattttactgcctaatatgttattatttctataacacgatgaatacacatggcctagagaaacccataaaacacagcaagcaataaaagctcgaggcgccgcacatagaggttaaggaaaggagctataaaaaaacatagtgttggggactgaggtgttctgaataccagagggcttggaatgctgcagctgtatcttagaaatttaaaggacagctccgaggggaaatagaacaaagctatgttcatgatgaatagcattaggaacagcagacacataacaggagagaagcaaagagaaattcaggcaggagtgtgtcatcatacctgtgaataggtcttggtttgtttcaatgctaaagtgaacaagaaatccaggagattgcactttgcagaattagaaattgcagtcggcactatcattgcactttgtgtagaaagtatttcatagtagagtctgtggatggaagggaaggaactgtgttcaaaccgtgttccatcatgtcctcgctgcaagaacttaggcttgttaacgtttctgactcttggtttctgcggtattcaagagaagctgtagccatagataatttatttgcataaatttaaagattatttttcaaagaaagctgtggatcctcggtgtgctttttatgtggtagatatttcttcaatgctggcaccactgagccgggggcttcgggagaaaggcaacagatcctggctctctggctcccagcagggctttctgtacgagggagggtggtgcccaggacccacccaagggaaatccacaggctgacaacacatcccccaggtgcagccaccgggcagctgtgggcaccctgcgtagcctcctgttttcctctggtttggccggttctgctcactcctgccccttggtgaagtcctgggccagttctcatgctctgtcctgatgtgaacattgaacaaattagaatcagggaagtaatgagatttacaatgattgcattgaaaaacagcggtccaagagatcattactcatactttcagcagtatttgtttactgtctcttaggagcaagtaaacaattaagaactttcatagtcttcagaaatgctttgaaacaatcattacctcgtagaaaaggactttattgtttttaggactgtcattatagagagaataaaaataaaacagatttcacagagataagaaccagttctgagctcagactaaaattttaatttatatatatacaatgtttaccatgtatattttgtattccaaaaatacacctaccaaataaattacaaaaaaaagattccattcagagtttctaccggatcttggcccagttttgagtcagaatttcctctaggtgatgcaggggactgtccaagttatgtgacatctgagaatcaaatgagaaaagaaatgaaaagcactaggggaaatacttagcactgtaggattacaagttacccttgtgaagaaataaaagtacagattaatcattaacctctgctgtttcccattttactctaagtattgtatattagttatttaaatctttatttactaaataaaatttagatgacatgcaatatagtctatttagcaagattatggaaaaataccaaagaaatgaaaactcccagtctgggaaaacaaaattatggaggaaaactatcaacatgtacgggatgtaggtgcctcgataattgtgatagctgaacttcaaatttcatccaaagtttcctgtccgtgagtcaggcggatttcaaaaattttctacttaaatacttctgacttttgtatttaaatacttggaaattgatatcctagcactacgttcaatagctgtcatttactgatccatgtatacatgtgtgtatgtgtgcgtgtgtggtgtatggggagagaggttattttgacagattgattttcttttatgattttctgtctaaaactagctcatgaaaataattccaaagagttatttttgaaaacattccaaagtgagtaccttgaagaacgagatttatttaaacacattactttatgcaggctcaaaaggtaaaagttgatgttattattagattatttcaccttgtataactacaaatgtataatattcatataataataaatattgaatatatgcatgaaagatgtattgagaacttaaaaatacatcttagaccatctgttttaaacatggacaggttgaggttcccagaggacgtctgttggtttggggacaccccagttcacctgctttttcactcaacctttaaaggcagctggtgatcgagctgagacagacccttttaatctaatcaccagggaactccagtaagaacagaataccctgtgaggcggtgtgagccacgcatataaacgttccttcgtcccaccgtttctctcattatgaaaaacactgcatattgattagtgtcctccccttaaatgaagtggttttgaaaacatctaactcatttcacacatggtttctttctcatctgggaaattatttatcggattgctttacttgtccaaatatgcatctcacccgatttttctagggagggaatattattgatattgtgaaggaaaatggtgtaaaattagattataatgatttttctctgggccggaaattttctcaacatatgatacaactgattctagaagtcattaaaacaaagggaaaacctatagaaagcatggcagaggaaacagccacagacttattttattatttatatttctatagcaacttgtctctcaagggtacatagtaattccatttccaagatacatacttgccaacatagaggagaaaaattatctctatatttcagtaccttgaatataagaggtagaataactgtttttcaatactatgatttttgttgcttttttaaaattttacttctttgctgaccttcctcagtttgaataaatatgactatgtatttgattctcccatttttagtcttttacaataaaagacagtgttttacttaattttatcttgtcacaaagagtggattttcaggcgtgtgagcctggggaaattttcatcgtggactaaacttgttgcctcaaccttcttctgataccaggacctggtaccgtcgagttactgtgtaactgatatgcaagtttgcctgacaagatggtgagaacatattttaaaacttgaatttgaaaaagtagagaatttaaaggaaaagaaactgaaaatggatgtcagctgggctgatcataaaacgttttggccaatagagtaaaggtgatttgaaatcacaaaataccgcagggcatattcaggtgtgttgggacacacaggcaccacttggtaaacccggccgatggctgccgagtgcgcagcaccccaggttggagggaggaggtgcaccccagaggaggaatacccgtctggccgccggctggctccgcaggcaggatgtctctgcagacgtgcttgctcggggaccaggtgtgcagtgtgcagcctttccaggtccacatacctctgaccgggcccttcaccctcctatcctcctttcccagagggctggcaaggaggccctgcagccagcttccctgcggagttaaaataaaacacgctatatggggaaaggctttgggaaggacatttagctctttactggaaaaatgagcagctggaggttctgtgagccacaaaatctgaaaaccagaagattcctccaaacacgtcttctccttggatctgtcactctgacacaagggctttacaaataggctcagaaactgttgcgcggggctctcagatgcatagcctcaggtcatagctttccataagtcaacagctatgcactgcgaggaccagcctgcacaccccacaaaggcaacaaaaagctgcgtttcagtaaacaaatgaccagaggaaatgaatgaaaaaagtcacacatgatcactttccgttttagaaatgtaaaaaatgaactagaataaagaacaatcatcttatatgccaattgaagattctaaagaaaagatcaaattacatttatgtcgtaagcatttattaagtgtttgctgtgtgccggccgctgcgctaagtgctctgaatccagaagcactgaagtcctgagcattggccccgaaggcctaaagtctggaaacagttgcagttgaagagctcgtcagccatggcacacctgctgggtgctgtgagatgtgtgtggatggctctggaaacccaggggaaagccagcactgcagcagcgtccgggaggccttccgcctgcaggaagagttgagaggcttcagggctgggcagcagaaacccagggagagggaggtgccagcctgaagtaatgacaaacgtcccgaaaaccgctgggcacctcagctctgggattcgcagggcacccggcctggagggagaggctggaaggcaggacggatgggggacatgagctgagagggacatccatgctgcacctgtagtacttgcacctgcagaattcggaggtcactggaggactctaagcaggagagggatctgtggctgagttgtgttccccggacttggtgctgaaccctaatcccaggacctgagaatgtgactgcgtttcagacagacccttcgaagaggtgaccaggtagaatgaggtcacagggggcccaaatccaatctgtccggtgtccttataagaagaggagatgaggacacagacatgcaggaagggaccagcttgtgaggacccggggagaagacggcatgtgcacacccaggagaggcctcagttttcccagcgccttggtctgggactcacagcctccatgacatgaatcaatgttgctctgttacggcagcacgggaggactaacacgggggccagagtcatgttataatgaagacccgcggcccggccgtactgcagaagagcacggagaagacagctcctcaaatagcacaggtgagaagggatgaggccgggctgtgccaggcacaggtgcaggaatggctttcagagggagctccaggggctcccggctgagctctggggagccgtgaagaggcttttaagaggcctcctgccccagccgtggatgaggcccagaaagccagcatgcaggcagggagtctccaggacttcatccaggaagctgggtctcccggggagtccaggaggagaggccgtaatgatggctccatttagggacagacgcagagaaggcagcggatgcatgcagatcccagcgatggggctgtgccgttgtctcctcctgctgaagcaacaggatggaggtgatgctgttgcagcccagagagctgggtcatggagtgcaggtaaaagaagggatggccagtacaaccggggagccgggatggattgggatgaagtgcccaacagccctctccagctgctgcctctcagcagccgaagccaacagggcccagcccacaggtgccgagtagttcagatgtgttgagctgagggtcccatgacttgctaacccaacttcaagaagaggtgtggaggtcgaggctggaggtgcggtccagagccatggagccacccccgaacaggagggtatagaaagagaagaggcctgagaccagagcccacagcgtcagcatcgtggggagaaggggcctccagaaggagcagtggaaaggtgggagccaggagggatggggaggggccacggaggggagttcaacactgccccagttcaccacagtgggaacagaggctgtccctgggtcttggcagtgtgggcagagtcctggaaggctgctgcgaggcctgaattgtgcagcccctctatgcggagcagcaggggtcctgtgccacccccgacccagggtaagcccaggttcctggtgtccataagccctgcacaaattcagcacagcggagacccctgtgggtcctcccagagacgggcctggactgaggaacccctacaaagcaggtgtgtttgtctcatatttgcagctgtaaaaatggtcacaagccctatggtctccagcagcacagatgtgccgtctcacagtcacagaggttagaagtctaaagtaggttctgtggggctagcgtcaaacatcaggtcgttctggaggcttccggggagcccgctccttgcctcctcaagcttctggagttctctgccgtccttggctgcgggccacatggctccagcctgggcctccattgtccaagcctcctcgtctgactctgaccccctcccttcctcatgtaaggaccctggggataacactgggcccactgggatgatccaggatcatctccccatctcaaaatcctgaatttactcacatctgcaaagtcccttttgccacataaagtaccatggtcacaggttctggggactaggatgcggacatttttggaggggcgttattctgtttaccatagtaggttttggtaaatactggtagagtgcatgaatgaatgaggtcttctctgaaaccgagcccagtataaatggtgacatccttcaggcactgacccaaggggaacccatttctcttctaggagtattacacaaatccttgtcgtaaatccaggttgatcctgatgaagaggagccaaatctggctcgggctgatggacgctgtgtgcaggctcagagttcaccctgggaagcccaggtgtgctgccccgtgggtcctcagtgtcagacctgctgctgaagggaagcccaggcgtgctgtcccatgggtcctcagtgtcagacctgctgctgacatcacgtctccaaccccgcagcacagcgtagtccaaatgccagaaacctggcaacaacgatatcgtgcgggagtcggtccgagatgtcccagggaatctgaacgtcttcccagccgctcaggatgtctctgattgtcatgatccccattagaacgtctcagaaactgccaaccaccatggcttccatgaagccccaagaatccttcagcaaagctccatgttgcaaactaaagcccagggtgtgcatcatgaagacgccatccctgtgtcccgggttcagaggcttgtacccgggactcgggcatgagaccccattacgggcctgagcacagcaccaagaccgtcaaacgctaaaaacaggcacaggtggaagtctcacgtggcccgcccccccgcatctagacttgtgttttacagtaaatgacgaaatgcagtccagatacctaaaagatgaaaactaatctttgtgattttcattgtctttgatttatttgaactacagccaaagccttatgtactttatccgttgtgcgctaagcctataggatgagtggatgaaagccggttggccctggggaccggtagggagaagccgtggcagagcacagtctctgcggagaggagggagacccaagctctcctggctgtggggaaggagaagccctgggagacacgggtaagggtcgggtgtcggagttaggacaggagcccctggtctgtgctgtagagaaggagtggaaccagctcccagtaagggtttccaaaggttaaatacttgacacctctgtctagaacagacatgacagacgaatcacgtgcctcccggtttgcagaaggcgagcgtgatgcagataaatcgtgcatctgtatcaggaactgcatatgtaagccagaattgctcgggtgagaacaaatgtgttcataaagattttccccaagtgtgtagcctgctcttcccttcaaaaccaccgttttcaagtaatttgtgtccttctcttataaaatcctcctgtctgcgtacttagactggaattacaacatgaatgctgggatgatctcccaggtaatgagatttcaagatgaagctgtcattgaacaagtgaacttgtctagacgaattaatcataatacgaatgaaactagagccacgggttcctgactcatagtccagggctcttgcagttgacaacgatctgcgtctgtcctatggctctgtctcttccctgaagtaggggtacatttggagggacatgtgtatggggatggagtcagaagtccagtgaggacttccacattgttgtcctaagagtaacagttactgtaagaaaggattcctaattggtcatttaacatcttatcacccagaaaagtaatggctgaaataaataattgatgcttgcataagtcagtaggtgaataaattagtcatttcaggttttcagatattgtggagatggaagtactgttgaatctgcctcccatacccctcgaacccgccggtcctcacctgtgtcaccctcgaccccgccggccctcacctgtgtcaccctcgaccccgccggtcctcacctgtgtcaccctcgaccccgccggtccccacctgtgtcaccctcgaccccgctggtcctcacctgtgtcaccctcgaccctgccggcccccacctgtgtcaccctcgaccccgccggccctcacctgtgtcaccctcgaacccgccggccctcacctgtgtcaccctcgaccctgccggtcctcacctgtgtcaccctcgaccccgccggtccccacctgtgtcaccctccaacccgccggtcctcacctgtgtcaccctcgaccccgccggccctcacctgtgtcaccctcgaccccgccggccctcacctgtgtcaccctccaacccgccggccctcacctgtgtcaccctcgaccccgccggccctcacctgtgtcaccctcgaccccgccggtcctcacctgtgtcaccctcgaccccgccggccctcacctgtgtcaccctcgaccccgccggtcctcacctgtgtcaccctcgacccccccggtcctcacctgtgtcaccctcgacccccccggtcctcacctgtgtcaccctcgaacccgccagccctcacctgtgtcaccctcgaccccgccggccctcacctgtgtcaccctcgaccccgccggtcctcacctgtgtcaccctcgacccccccggtcctcacctgtgtcaccctcgaccccgccggccctcacctgtgtcaccctcgaccccgccggtcctcacctgtgtcaccctcgaccccgccggccctcacctgtgtcaccctcgaacccgccggccctcacctgtgtcaccctcgaacccgccggccctcacctgtgtcacccctcgaacccgccagccctcacctgtgtcaccctcgaccccgccggccctcacctgtgtcaccctcgaacccgccggtcctcacctgtgtcaccctcgaccccgccggtcctcacctgtgtcaccctcgacccccccggtcctcacctgtgtcaccctcgacccccccggtcctcacctgtgtcaccctcgaccccgccggtcctcacctgtgtcaccctcgaccccgccggccctcacctgtgtcaccctcgaacccgccggtcctcacctgtgtcaccctcgaccccgccggccctcacctgtgtcaccctcgaccccgccggccctcacctgtgtcaccctccaacccgccggccctcacctgtgtcaccctcgaccccgccggccctcacctgtgtcaccctcgaccccgccggccctcacctgtgtcaccctggaacccgccggccctcacctgtgtcaccctggaacccgccagccctcacctgtgtcaccctcgaccccgccggtcctcacctgtgtcaccctcgaccccgccggccctcacctgtgtcaccctggaacccgccggccctcacctgtgtcaccctggaacccgccggccctcacctgtgtcaccctcgaccccgccggccctcacctgtgtcaccctggaacccgccggccctcacctgtgtcaccctggaacccgccggtcctcacctgtgtcaccctcgaacccgccggtcctcacctgtgtcaccctcgaacccgccggtcctcacctgtgtcaccctcgaccccgccggccctcacctgtgtcaccctccaacccgccggtcctcacctgtgtcaccctcgaccccgccggccctcacctgtgtcaccctcgaccccgccggtcctcacctgtgtcaccctccaacccgccggtcctcacctgtgtcaccctcgaccccgccggccctcacctgtgtcaccctcgaccccgccggccctcacctgtgtcaccctccaacccgccggtcctcacctgtgtcaccctcgaccccgccggccctcacctgtgtcaccctcgaccccgccggccctcacctgtgtcaccctcgaccccgccggccctcacctgtgtcaccctccaacccgccggtcctcacctgtgtcaccctcgaccccgccggccctcacctgtgtcaccctcgaccccgccggccctcacctgtgtcaccctcgaccccgccggtcctcacctgtgtcaccctcgaccccgccggccctcacctgtgtcaccctcgaacccgccggtcctcacctgtgtcaccctcgaccccgccggtcctcacctgtgtcaccctcgaccccgccggccctcacctgtgtcacccctcggggctgaaaccattttaagtgctcacctgggtgcctcctcagcctccaggggcctggcaggacttcccacccactctccatcctgcctgcaggacattcttgctaaaaaggcagcctgaccctaagcccgcccgaccaagagcctcgtctcggctctgtgcaagagccagaggagtgaagactgccgtcctctgtggggttgcaaaccccagtgacccggccccaccagacggcccagctgccctctcgctcccacccgctcccagccagtcttcctgaaattctcgcacctccatgcctctacggctgctgctcgtcggcccgcagtttcttccttgagtttctgcctgagtcctagctgtgctttaagccccagctcaggaatcatttcttcaaggaagcggcagagacgcgctcctgatctgatcagcgtctgcacgaagcacggcttctgctccttcccactccctgaccaggagctccagccacatagcacatttactgaaacaaacagaatctcgatgtacatttaaaatgtacttatcttttaaagacataaaaacattagatgccaaaatatctaggccatggcagagaattatgtttattatttgtatgccattacattgtctcaggaatatatttaaaatgtattgacaccatggcttttactctaacaggatgttcgtctaaaaagcattacattaaaaacaaattatttagattcataaaattaaaaatattctgaaaacattgagaaaaaaatacttttgctctcttagggaaaaaaaactagagtgatgcttttaaatgaaattacttgctgggcacagtggctcacgcctgtagtgccagcactttggaagggtcacttaaggccaggcattcaaggttagagagagctctgatggcaccacagcactctagcctgggtgacagcaagaccatgtctctaatgaatgaatcaaatgaatgaatcaaatgaatgaatcagatgaatgaatgaatgaaacagaatcattcaacatcagtacagaccacctttgacttaaagatggttggacttacaattttttaaccttataatagcgtgaaaatcatccacattctgtagaaaccatactctgagtgcccacacaaccattctgtttttcaccttcagtacagtgttccatgaattcgaggagatagtcaacacattataaaacaggcattaagtgagacgatgttggccaactgcaggccagtgtcagtgttatgagcttattaggagtaggctgggctaagttacgatgtttggtgggttaaatgtattaaacgtgtttcccacttacgatgtttttagtgtatgatgggtttgtggggacataatcccattgcaagttgaggagcatctgtatatttattttttccctgtaatgatgcaaaatatggactatatggagtcacatttgaaatatttaaaatgtgatcatgaagtcctatagatacatttgtgttggttgattatccagacaataatcttacaggtactatgtattaccttaaaaggttgtaatttatttgctacttttataacttgaaattttcttcctttgcttcatgggtttcaagagtcattgacatgatttaataggatatttttggacttaaacaaaattgcttcctgataggtattcctagatcccagagagttaaccttaaaaagatctttttcctgtgaagcatcacatggaaatgaaaggggagtggacgtcttgctcccaacacgtcatattccagccttgtctttcccgttcagtttgcgaatggttaggtgatgtttgccattggtggtggaggccgaataatgccgcacagttctctgtatgatagtgtgatggtggagttcatgtggcaacttgactgggccatggagtgcccagatatctggttaaacattattgtgggtgtgtctgagagggtgactctggatgaggttagcatttggaggggtggacgaggtgaagcagatgctttccccagtgtgggtgggccacgtcctatctagtggaagaaacaaaacagctgactcttccatagagagagggaattcctcctgcctttgaactgcgacttgcaccatgagcccgcccagatctccagcttgccactctccctgcagatctcggaactcgtcagcctcattgacgacaggagccaattccttatcctctttctctgtatgtattcacctgtgtctctattgtctgtctcttccttaccatctctctctatatgtgttcatctatatctctatcgtctgtccatccatcccacccatgttccattaattctgtttctctgaaaagccccaactaatatcatacccttaaagggtattttttcaggttctgtatttaaaatgatcagagaatttactaagagaattctcaccatcagctcttcacactggaaaacaatttgaaaattaaaaagctaggtcagaaacttcagtccttgtagctgtgttgggggaatgttcattaaaataaaggccgctgtctcagtgtcaatgtgctgtttgaaaacaggtgtcagaggcacagtctctgctgacaggtcgaggctggcactgctgggacaggtcactagttaggctggtgtgtcaggagtgaagggggccagagggcaaacggatcaaaatccccttctggaaaggagaacccaggtgggcttggaaagccagcgtcgaaaacttttgtcccttcttctaatcagcgtctgtcaccacagagaagtgatggaaaggccagagaagcgtcggaaaggccagggcacagggcagaggcagaggtgagcggacagtggaggaggatccaggacttcagcagacacagggctcaggctttggctcatctgacagcggtgccggggcatggaggccaccaccattgaaggcctgtggactgatggttccagggacagagtcctctgtgaatttccagcaggacactgcagtgagactagtgcagacagtcccccagctggttgctggatctggaactgaagtctccaagctagagtccatgaccccaggggaaccctagcgtaaggtattcatgaattcagggctgctcacagttagatgggataaaaagtgtgtctttatcctggctaacacggtgaaaccccatctctactaaacaaaacacaaaaaattagccaggcgtcgtggtgggtgcctgtagtcccagctactcaggaggctgaggcaggagaatggagtgaacccgggaggcagagcttgcagtgagccgagatcgcgccactgcactccagcctgggagacagagagagactctgtctcaaaaaaaaaaaaaaaaaaaaaaaaaaaaaaaaaaaaaagtgcatctttatcttcactaactttcactaacttgaatttacaatttccttccattatgaatgcagacagcagaacacattcctatgagattcatgctaacaatatcaagatagcttatcatcactgaagagttcttgcaatggtctggaaacaccaccctccccacgcttgaggctgcaggagctgccagtcccctgccgggtctctctctcattgcatgccggctgctataaggaagcgtcatagcctgcctggcttatgaaccccagagatttatctctcacagttatggaggctggaagtctggggtcagggtgtccagtgtgggcagcctccttgttcataggcagcagcttttccctgcgtcctcacatggtggaaaaagcgtaaggaagttccctaggatccctttataaaggcacgaatccctcatcctgcccccagacaatccacaaacccacggtcacagacgtcggtcatctcttccacatttcatgtcactgccatgcccaaggcctgtggcgataagccagatgagtttaaattaacccgtgcgtgtaccgtgccacaccaggctcaataaatattggttcaacgtatgagtgagtgatttgaaaatttacagttgataagctctttaattccttttctattgagagtttgtcctaacttagaggactctgacgtttaagttataaactccactgtgctcggctgttagccttggcatcgacttgagcctttttctgtagagttcctttctgaggacaatacttactcaggggcacccatgcatccttatcagatgttctatgtggacatgattcaattatctataaccgacatgtgcaagaaataacatttttttttaaatcaacttccattctaagttcccacccctcctgcgtggtgtactgtgaaattcagcctctgtcatttcaggttaaacccaaggcaataccaaaaccaggactcccaggaggtttggaggcatctgggaagcctcctggtcataggccattggtcccctcattggtcccctccggctgttatgagatccccaggtccccttctgcatgcaggattcgctcaagtctgcagaccttccctggggcatgatcaggacaggggccgtgttctgcagctgctcagagacccgcaggtccccttctctggctgtcatcattcccagcttccggcctctttcctcctctccctgagcccctggtcccctcagtcatgtctctactgagtacaggcttttgtgaaagtcatggtgatctttgccaatggagaggatatcgtggggttggcttcctcccatagaaatctctgaaaagaagaaccgctgatctcacttgaaatgggaagaattgtggggaaaacctacaaatcctatcacaaaggtttattctgcaacgtgagtggagtgcaggcgtttcccagatcggcagccaccacgaggtcatccttggatggcgtctgaacacatgtctggggagaggtccggaggggcccaaaaaatcattgcctgtgacgcttcaaaatttaactttattctccagaaaagtaaaaattatccaggtgtatacattgaatttgaataactgcctttacctaaagcttaagatgtccaaaagccaatgctatatatcaaaaatatttttaaactgaagcaaaaacccaaccagtaaattctttttgtttcttcaaagctaccagaacactcaatacccagtgtctaaattctttttgcttcttcaaagctaccagaatactcaatacccagtgtgtaaattctttttgcttcttcaaagctaccagaacactcaacacccagtgtctagtcattgctatttatattgtcagcagtggtgttggggtaaacagaatttatttaggccattttaatgttcccaaaattaaagcaagagattaaatgagaatgattactctgaattaatctttgaaccctttttcaaacaccaaaaatgcagagtgctagaaatttaactggcaagtttggtctatggttttaggtacttggatggtgagatctgtatcactactgatattttccaatgacatagaaggtggcaacaaaatatagtaaggaaatagttatataggaaggaaatatctatgaaggtaggaaaaatactcctttctaaaatatttaattatattggatttatttcatcctaacataggtattaagatagaggatcgtgctgtgctttttaaacgtaagtcatgggaaagctttgaaaatcccagtggattcatcatggggaatatttgtatctctatttatttatttatttggttttggaagccaggaaggaaagaaataaagaatggaatgatggatcatatcaaatgttaccatgagtacaaggaagataaagaaaaagaaaaagattcattagctaaggcagctgaaagatcatggttgacataggcaactgcagattcatggaatttctggagaaaaagccccacaccttaaatatgcgggcaggttacatttccaagtctttcagtggcaggatatgctcctactctctttctgtaataaaaacgagtatttcttgtatccatttattggtttacagcaggtcattactttataaccatttcgatcaattacacaatcaattgaacaaactcacaaatatgtatttggtacctgatgtgtataagataatggagaggtactttataaaaggaaaggaaacagaattggaaatagatttagaagctccatatacatgaagagataatcatgttcaaaaacttttgtcccttcttcttatcagtgttggatgattataaactgtcctatgattcataaaatagtcaaaattgctgtctcttctaaatattgacagcataagcttagatcttgatgtaattataaggcacaggagtggtctctcacacgcttattctgtgtgtgcgataaaacggaggttttatctgtgagggtattctaaaacacccgtgttatctggcagatggcgcttaacagaaatgaattatttgtcctcttcggctattccagaaaaagatactgggtgcttttcaaaagatcctcagaatctgcatctgcatttcttgaccaagaagacagaagcttgggtgacagttgctggagcagagatgggaggagagtagacacagaagcttgggtgacagttgctggagcagaggtgggaggagagtagacacagaagcttgggtggcagttgctggagcagaggtgggaggagagtagacacagaagcttgggtgacagttgctggagcagagatgggaggagagtagacacagaagcttgggtgacagttgctggagcagagatgggaggagagtagagacagaagcttgggtgacagttgctggagcagagatgggaggacggtacggacattcctgccattgctgctgcttctcatgtctgcctccagcatctaccaccaagaaaacccctgctcagcggaattttgggattacatggggaataatatggggaactgtgctaacagatacgtgtatgcactttctcaaacgtaccatccagcgtccacattctgaagataaacaggtttaccaattctttgcaaacactcagacaccgtatttcttcctccccacctctgcctcacagcagaagggccaggactgaagcaagagccacacacatatgtggctggaaatgttgacccaccagattctgtgtgttctgtgtggcccttcttcacagggtgccctgagcccaaccgaatgaagcgctggccccgtcagcagccatggtcacgtccacttggaagttccaaatcccgaggttcctgcagagagcagctctctgctgtggcaccagctgctggtgagggatccagctcccctagttacctcccccatcaccaagagactggaagttcctggcatacaacataggctgagatcctcaactgagctgcttctctaaagcaggggcagcgggcatagctccagcacatggcggctggggcgtccatcccttctggaatatgccctgccatgaccaccccactcctgccgggctcctgcctggcccacagctccaatggcttaagcccctagctccgttctctgcgttcacaaaaccaccacaggctgtgtagccctccccatgtgaaataacaggggaagatgtctgacttacaaggcaactgccaggcagcaaaaatccttctgatcgtattttccatctgggtatgtgctcatcagaagtaaatttgaaaagttaaaaaaaaacgaagtgatggagggacacagtcttgtgtgtgaccacccgaggcaagccccgcctgcacctctggtcagacattcctcagcgccagccagcctttgcatgaggcagcactcagagcctcgtcagagccgggctgggcaggcagcctgccccaggcacctacacagctcgtttctgcaagccccacttgcccagtgaggctttctctttttccttgagaattaagttggtttttttctggtcatacactctttaacatgcaggtgtagaattaagagatatttgtgtttctttcctaaatgattccataaacctggtgctaaggaactattacattagacccttggtgtaggcagcaaaggagattgggctttacgcacaccgaggttcttacgtgaagatgctaatgacattcctcctggagtgtgtgtgagcccaccacgttcctcatcctgttatgtatattttagtaatccattccattcattgtgagtctctcccctggctagaatataagttccacaggggccgggttttcctcgctgctgaattcccgtgcctagaacagtgcttggcacatagtagatagaaatgtttgttgatttatttagtgaaaaaaaggaataaatgaatgaataagaaggattctctctctgtgtgaactactaccttagcactgctgcccacttgcaactaaccctggtcttgtgcgtgatatttctgagtttccaggagagcagagacaaggtagagaataaaaccctctgtcaggtcaacgacacctaggaagtggtaggcggtccgtagatttttggggacatgtacatggatgaatcagtcctttctgtgcacttatgtaaaacttattttcattccttatggaatttgcatcgtctgtttctgtcattcttgaagtcagggtcagatctttattttaaaataaagaataacatgcgagacagacagtaatgagaccagctggcgaaccaaaatgttatgagcagtttctgaaaagcaaagtaaattgcctccttggtctatgtatcatcccatcagcgttcgtatctcaaggctgtgccacagatgactcattgtgcaattatcttgccagcctctccggtccatatgccctttgccttgggcccatgagagtcgcaatttcctggtgacccagaggactgtcatgggcctttctctattttgttagaagctcttcattttcagggtaccactgtaaatgggggatttgaaacacatctatttcgacgattaggatgaagaaggagtgcccagttgctgccaggcctggagatactgtggcatcgcgttggttcttagtgctggccctgtgggtggggtagggagccgacaatcctcaccacgcagatgctgccaggcctggagacacgggcagcacgttggttcttggtgcctggagacactggcattgcattggttcttggtgctggccctgcgggtggggtagggagccgacaatcctcaccccgctcacggggaggctgcaggtgcctggggtcatagggcttcctgtggcggggccagaaccgagcccgggtatcccgtggccatcccacaccctcactgctctcaaggctgccggcttcctggccccacaggtgtcgttcatgctcagctagctcaaactgatgcttactgatccacataggctctggaggttcacagagcaacttcagtgcaaggagccctgatttattggcaggaccaacggcagccctctgatgggtccgtctctcagatccgtgggcagagggcaagtcaggatgtttgggctgtaaattgcaggggtggattcctgtatttgcttgggctgtgaactgcaggggcggactcctgtatttgcttgggctgtgaactgcaggggcggactcctgtatttccttttccattagggtcaccttaagattgagattatgacatccatagtgtgggtttgggaccttccaaccttctgatcaagctttatgggagacgttgacatgatttaggatatattcatttgactctgaggtgtaagtcagaggtaacacggtcttaactcttgtcagttgcctttgctttattgttttattaattttttaattgaaggtcacttccttatccttagaaagagagacattagtaacttcaggtatgttagttgacggatcaatgtctgcgcactcactatttgccatgtgcatggtaaaaataaactctcatcatcaaataaaataccacctacagaattagccctcccttgaaatcttggtagtaaagatttcattctgatacaacttcagtatagatgtcattcacaattaggtgtcccgtgtacgcacatgcacatatggagagacacactgactgtgaagatgtgtaacaaatgctacctcctgtacagttcacagcatctcaaaaaacaggcccaccagcatcctccagttcttggtctcttcatttttccactggaaaaattattcctttcaaacatgttttcatctaagaagctttgcattcttaaagaattggaacatggccgggcatggtggctcacgcctgtaatctcagcactttgggaggcagaggcgggtggatcacctgaggttgggagttcgagaccaccctggccaacatggtgaaaccccatctctactaaagatacaaaattagccaggcatggtggcaagcgcctgtactcccagctactcgggagactgaggcaggagaattacttgaacccgggaggcggaggttgcagtgagctgcgatcacgccattgcactccagcctgggtgacaagagtgaaactccgtctcaaaaaaaaaaaaaaaaaagaattggaacataattgtgtcctacttatcaattggattgggaaggagccaaactatgttgctgatatgtttctgttttttgtgtgtgttgatgtcaaatcatcctaaaagtcagtgtgcgccatcactgatgatgcattccttttctgggttatcctttagttttgttacctggccctttgaacattcaaaattctgtacttagaaacatgtgactcttccgttcactaaacgttgatgcattctcagtgttcttcagaaaatacaagttctcgccgtgtgatgtgatgttcaaaccttttcaatggaaacaggaagtgtctcgaacagcagagcagctgacatcacttcattttactgtctacatgttaaatgctggtgagactataatttcttgctaattaacacattcaaaatagacatctttgctgctagcctatcaacgttgccccagaacttgtgggacccacataatttcttgtaacttcaggaaaaccattgtgtgtatgcttgtgggatgtgacttctgtgtcctgtctgatttattcttctgttttgtgactagcattaattaaagtgtcaaaatggctttgatcctctatgttgaatcttttgccttgaaagtttagtttgtccaatattcattctctcattcagacagtcatgggcttgatgactgtaattccttttatgctatcatccttgaagttctaattaagagagtgcaatgaatgcaagtgtggctgttacattcaaatagaatggcaatgcttgccattcaagggatattttatcttgattacgtatttgtgccttatacgatggaatgctaattttcaaattcccgtttggtttgcaaatgactttcaagcattgaattcagaagtggtgtccagaattccaggtgtagaaggataattaaacatgtgtttaaagcgatgatggattcacatttgcgattcctcaaagccatgtgaagtgtagattgtggagcagtttctttcatctcattcacacgagcttctttccagtaaaatgctttggtccaaaatctcctccacgaggttggctaacccaacaccttgaagacctgaaggaccttcatgatcagagtcctctgcttcatgtgctgtgttagaacactcagggaactatgtccagacatggcctcttcatgcaggacatgtcctagacagcgctgccagcacagccgtcatgatgaggaagacgttccacgcttaggcaggccagcgtggtagctgctggccgcacctgaccatgaccagtggacacacagcgtgtgccgcagaggaacccaagtgtaatggtattttaggtgttcagatattttagaatattggaggccaggtgtggcatctcacagctgtaatcccagcactttgggaggccaaggcgggcagatcacctgaggttgggagtttgagaccagcctgtccaacatggtgaaaccccatctttactaaaaatataaaattagccaggcgtggtaccgcgtgctacttgggaggctgaggctggagaattgcttgaacccgggaggcggagattgcagtgagctgagatcgtgccactgcattccagcctgggtgacagggcaagactctgtctcaaaaaaaaaaaaaagtttgagccatttgttgtggccagtagctaagttattggtcagggcagtctagaaaggagcctttctgacacaactgtggtaaacctaagaatgtaggcattttcaatgggtagcagtctcccaccccttcactctgccaacactgcagccaccactgcgtatttgtcaattgtgccatctccccttctgacagtccttttgactccagatatttgggcaattttttcagaaggggtttgcaaatgaggtgggctcaattccagatacatctgaggaaagtcagtttttacacacctcttccctgccccatttattcagctctaacagggagggacccatccacctgaatacatttcctttaagcatcaacactcttcatttcatgcaatttttatggaattcttcctaaaacttactatatgtgtggctctctccatcctaagtagtgtgattaaccttttcttcgtgccccaagtcattccattggcctcagagtactcaagaggcaaagcatgttacacagttccttctgatcacaaccccattattctcagagtgacaccaacttatgcgatccctgtgaaacaaacaaaatccaaaccaattcagtaattgaattacaaagcccaggtatgttttcatctatttccctgtaatttggaagacacttaaaaaaaatcatcagggattttatagtgttgtttacatggtaaaagaaaccaatgctaggctttaaaaaccaaacagatactcatgcttggaataggtattttttttttaaagaaagtagtcaggtcaggtcttcagaaactttcagttattaaacaatcatttcttcttctaatttcaaaatacatatttgatcacttatataatcccatgtggttgtttagtaatctctgtctctgtcttgattcatcttctttttaaggacgtagactagaattacattgctaaattaaattttgaattttcaaatacatttaatgtttgacatacatatagaaagtgatagataacacagcctatagctcataaggattagttgtgataaacgcatgctaggcgtgcactcacagaaacagaatgaagacgattattatcacccacaccatccaactgaatggctggatatttttctctaatgtgtaaaatgctttcattcattgattttaatctgtggcagcaaattaatgtggtcaaatgatcattttgaattctttctttactattgtttcccagcctccaattttaactttaatgagccatgtagagatttacaattctatcacacagggctgtacaggcacaacaaatgtttgtcaaaagaatggattaatgaatgaatggatgcagtgatatacttccatgtttcagaaatcatttcttaatgttaatctctatatcaaaatcattttatgtactgcaatttttatttaaccaggacaactgataatttttaaaatatagaaatcaaatattgccaatataaggaaaatataagtgaaacagcttcgttgtctggggtataaaccctggtccttttgtcacagccgagaaagaatttacgacatggacacatggttttagggggcgaaaagtttaatagaaaaagaagtgagagagaaaagacttccttatgctgagggagcagatcgcccaaaagaaagtctcccgtttgcagcagaatgcaatcggttctgtacagaggcttgaggaggtggtgattggcttacatagggcccaggggattggttagaccagatgtgacatttacatagttcgcaaaaagactggccctcccaccctcgtcttttattatgcaaatgagggctccaccctccacctggctggttgccatgatacctgtatacctggctttacctggaggctgccatgacaccctgcacatactgacaagcaaaagcgagcaggagatgccatattgaatgtacctggcttccaggtacagctgctccatttacatatgaaagctcctagtctgcatatctatgcctgacttcttaggcagctttcccttaaagaagaaacggtttaggggctacttttttatatatatactttaagttctgggatacatgtgcagaacgtgcagttttgttacgtaggctatggatccgtctggtcctgggctttttttggttggtaggctattaattactgcctatttcagaacttgttattgctctattcagggattccacttattcctgtgttagtcatgggagggtgtatgtgtccaggaatttatccattcccttctagattttctagtttatctgcatagcggtgtttatagtattctctgatggtagtttgtatttctgtgggatcagtggtgatatcccccttaacatattttattgtgtctatttgattcttctctcttcgcttctttattagtctggctaccggtccatgtattttgttgatcttttcctggattcattgatgtttggaaggtttttttgtgtctctatctccttcagttctgctgtgatcttagttatttcttgtcttctgctagcttttgagtttgtttgatcttgctactctagttcttttaattgtgatgttagggtgtcaattttagatcttttctgctttcttctgtgacaattttgtgctgtaaatttccctctaaacactgtgttagctgtgtcccagaaactctgtgtcccagagattgtgggacacagctaaagcattggtttcaaataacttatttatttctgccttaatttcgttatttacccagtagtcattcaggagcagattgttcagtttccatgtagttgtgcggttttgagtgagtttcttaatcctgagttctaatttgattgcactgtggtcggagagactgtttgttatgatttccatccttttgcatttgctgaggtgtgttttacttttaattatgtgtttgattttagagtaagtgtgatgtggtgctgagaagaatgggatattctgctgatttggggtagagagttctgtagatgtctattaggtccacttggtccagagctgagttcaagtcctgaatatccttgttaattttctgtctcattgatctgtctaatattgacagtgggatgttaaagtctcccactattattgtgtgggagtctaagtctctttataggtctctaagaacttgctttatgaatctgggtgctcctgtattgggtgtgtatatatttaggatagttagctcttcttgttgcattgattcctttacctttaggcaatgcccttctttgtctttttttatctttgttggcttaaagtctgttttatcagagagtaggagtgcaactcctgctattttttgctttccatttgcttggttaatattcctccatccctttactttgagcctatgtgtgtctttgcacatgagatgggtctcctgaatatagcacactgatgggtcttgactctttatccagtttgccattctgtgtcttttaactggggcatttagcctgtttacatttaaagttaatattgttatgtgtgaattagatcctatcattatgatgatagctggttattttgcccgttagttgatgtagtttcttcatagtgtcaatggtctttacaatttggcatgtttttgcagtggctggtaccagtttttcctttccatgtttagtggttcattcgggagctcttataaggcaggcctggtggtgacaaaaagctctcagcatctgcttgtctgtaaaggattttatttctccttcacttatttagtttgtttagtttggttgcctgtgaaattctggttgaaaattctttaagaatgttgaatattggcccccactctcttctggcttgtaggatttctactgagagatctgctgttagtctcatgggcttccctttgtgtgtaacctgacctttctctctggctggagggctgcttttcattaaaggaaaattctactaagatctttcaccttttctagctgcctaaaaataatttcttaataactgctgtattatttgtaacttattgttctgctataaacaatccattcagaatgcatgagggattatattatatgcatatacgcccactgtaagtgagaatgacaaaagctatatttaaaatatattttaagtgcctgtccctggtcttcacacacagatcccccttgacctctgtactcacatgtaaaaatgcgtctggtatctgcatacctggaagtttttatgtgtattgctaaatgtttctttaacttctacagtgtttccaattctttaaacgctacaggtcagttatttctattaaaactatgtgttggatttctcatggggtcattaacaaagggacttacatggacaagtgattaatatttttaggggattaaaaatatcctaccaggacacatattccctcctgcagagatggcgtttcagatcctgtggttggtaaaccctcagatgatcaatcaaaactttcccttggtcctttagctaaatggcccaattgtttttgagagaacctgaagttctgataacatagtgggcttttccccttgaatggtgtcaccgaagaatacacggcaccgtgattccgtagctaataccgcaactttcagcaacaaggctgctggaaccggaatcttgcacttcctgtctacgagacagggagaaacttcacctgtttctgctggcaagggttgggggaggctaggggacaaatccatgtaaagacagcagtgactggcagttcacaagtgttcaagctctagctctttccaagaaaacgttgtctaaatagaaatccttttcaaagcctttcaagctggttttcttcctgttcacgttggagccccaggagagctctcattctcagcctgctgggcccagcttctcctcatcccgctgaggtgctgcgcctcatggtggtgggggctgcagacctgtgtggtgcatgaccacctgttctccatggcctctactatgttgacatggccagtaggagcactgagaagaggcagggagtaacatcactgttgacaaaaggccagaagctgggtctaagttctgctgcttactgcacagaaagccaatcactgagacagcgagtattgccagggaagaaggctttcatcagatgctgcaggaaaggacatgggagatccatctcaaatccatctccctggcaaactaaaattagaggtttatatagcagggaagaaatgtaaccatgtatgggaaaacagaaatgagggagctgtgaggaagaggcggccaccaggaagcagatgatgggttgggcagtcagagtggatgtgaggtctttggtctcattgtctagatgcagtgatctggtgaattggagctccatgatgctatctgggaggcctgatggctgctgtccttagaaaggaactcagataagacagatgtaactttctcaggtttcaagactaggagggtcagtttctatgtttatctaaagaaacccataaacatccgccctatgggacaattcagccggtgtcatcaccatcactcagctgaaacagagagccagatctcctgcaaagcccgctgctcacagtatggtgagcctgggtgctctgccagagcaagaccacaggggaagaacacggtcacgctccttacagtatggtgagcctgtgtgctgtgccacagcaagacctcaggggaagtacacagtcacagtcacagggctgccgcaaagggtcttccgcccataggtcatgagggatgaactgatgctttggaaatcagtgggtcccacacacctttcctatgaaccaggaaaatatatcatcaagccaataaacaaatattcgaaggcctctttcccaaaataattttcattgatttggtatgatttaaggaattgaaagcccatttcatataatctcctcttactctggcttaagcccattagttaatagtccctttaaacagtttgggtcatggagtgtcagggtataatctttaaaatatcttctgccaccaaaggcattttgattttttgtttttaggaaacctggaaccgccataaatcttgctgaaataagtgcctctttcattgaattttgcagtgggcaaggattctgacgtgcactcttggacccgtctcttaaatgagaaaacactagatcaggtcatgagaaataaggttctgctatgtaaatggtcacaaaaaagaaaactagactcattataaccaacaactggagaagcatctgaatctcagttctaccatttttcttgtgggctgatgtcaggaagaggtttaagcccattcagacttccaccttctcttccaagatatgcaaatgccaagaccgcctaccccacaaggttgttctgaagcttaatgaactgcaaagtataacgtgctccacagagtgcctggcacatgtgtgagtgtggggtgtgtgtgtacacacgtgtgagtgtgggctgtgagtgtgtgcatacatgtgtgagtgtggggaatgtgtgcctgtgtgtacacgtgtgagtgtggggtgtgtgcgcgtgtgtacatgtgtgagtgtgggggatgcatgtctgtgtgtacacgtagtgtggggtgtgtgtgtgtacacatgtgtgagtgtggggtatgactgtgtgtgtacatgtgtgagtgtggggtgtgtgtgtgtgtatacctgtgtgagtgtgggggatgtgtgcctgtgtgtacacatagtgtggggtgtgtgtgcgtttgtacatgtgtgtgggggatgtgtgcctgtgtgtacacagtgtggggggtgtgtgtgtgtatgtgtgagtgtgggggatgtgtgcctgtgtgtacacgtgtgagtgtggggtatgactgtgtgtgtgtacacgtgtgagtgtggggtgtgagtgtgtgtgtacatgcacatgcgcactccaaggtgacttttctttctcatactgaagaaatgaaggggtggtggcaagtttgcagctgctgctggcattttcttctctcctttgatggtggagtcggccagtgctgtttggggacccggtggtgacagcgcccttactgtgcacccgtcttcgccagcttctctggatgcttatctccgcttcgtgggacgccggacaccgcagagcaccctcagacagagggaaggcagtttctccaagatcacatgatgacatgctttcatgtctgaagcaagaaagattgatttaatagaaccagaaagaagtgtgtgagatttccctgtccacagattttgcaggaaaggaccgagaagcccccctttcccttgcgccctgagcgtaatggttaacttcgactcacaggggaggtttggtctgacagctgtgacttgcctgtgagtctgtggatcctgtaagtgaaactcaactgcagggagtggtaaaaatcatctcaagatattaaatcaccagaggaaagcagagcaaaacaagcgttccagcatcacagcgcatgttttgatttagaggaagagagaacggcagaatggtcatttgctgtttctgccagaaggtaaatagtttgaggaaaactccatgacgcttgtaaagaaaagaagaagtcaggccgtatccccagagcactaatgtgaccagtcggttcagcccccagaggagcctgcagaccgctggggaaatccaagtaaagtttgcagtatccttatgccagagaatagtggttttgttgatgacaactgatccactgataccaaaccctcctccaccagggctgcctttctagagctgaggctgtgggtgcgggcacagcagcatcagcatttctgtaggacaggccatgcccactggccttcccgtggcagcgttggtgcatctacaggacaggccgtgtcacctggcccttcctgtggtggcatcggtgcgtctacaacacaggccacgtctactagcccttcccgtggtggcatgggtacatctaggcacaggctatgtccgctggcccgtcctactcctgcttcccaggagcagctccatccatctcaaggcacggccaggctcacccccaggaagcttctttcaaccccagtctctctctgggcatccctagtctctgatgctgcacccttggttctcaggacggccttttcagtgtgattatggagcacactggggccaggctcttaggctctagataaatgcttcctgaaatcagcgaatcttacaatgttgtatccaccagtgaagcttgccaggcactttacgtcggtgcccaacgtggaagaaagcccagggtcttcagcccccttatcaatggtctctggaaaacccatatggtaacagcaaccatatggacattcagttcgacctggacattcagttcaatattgcagccttgctgataacggtgaaaaacaatactctttcacaaagttccaaccacaacttttacgaaagtcagtcagtgataatccctgtatcactgcagcacagctaattgcttcaaaccacgttttcgttttagtggttttgagaacaacctggcaggcatgtgcacacacacttagaaagagcatcatgtctttcttttgtcatccaggaaaaatcactgtgtgtgccctgccaggtagagtgtagtaaattcttctttttgtacgctggaggtgaactgctccttcttaatctgtttgttttaaaagtgtggcatgcaactacatttttacaaagaaatcagtttaaaaaatcatttcatcagcctgtagcaaacacattataaagtgagaagatgtggtatgtgactttcctgtgatcatggagataagtcataagctgccccatacattttttttaatttacgagatattccatacaagaaggaaggtttacttgttttgtgaaatttttcagactctttaaattttacttaaatacacttagtgaggtctgtgattttgaacagtggcgacagacctttgagagtaactatgaaacacataatgagccaaggtggggatgaatttgcatgcatttgctcaaattttctgggcaggtcactaactgattacttcctccctgttgcatttgcctgtgacatgttgtgacatggttatgacgcttgatatgtgccatcgttcactgcttaggtgaacctcgctgggaaaatccaaccaatttggcgtgtttaatatcacctttctgctcatctcaaacttgccaaagaaaaatataataaggcagatgtcacattttaatctatattcccgcgtctctctgttgcctttgattttttactacccctattgctgggactcaaaacttcttcggaatcaatatttctgcttaagagaagcaacgcagagccagctttgccactggagaggtcattgagagcccccgtccgcagtctcgctccagcgcgcagcggacaccgggcctgccttcggccagagccgtagaatctgaagacgtgtcattgatgataaagattctgttttctgtaaatgacccatgacaaatgggttaccatgaaaacagccgcctactctccagggctgtcacgtggaaacccctttatcgatgagccctcctcacatctccacccgcgggctctctgaccatgtgtccatgtcgcactcaacacccttgataaatcagcgctgtgaaacactgccaggaaaggcgtcatcagaagcaagtgtttaaacggacctcatccctgccaaggtgagatgaatgtgcagtccccaacgcgtcccacccggaaaaacgaaatatttcctaacccaggtctctccccggcactactggcctttgggatggagaagtcttgggaactttctgagtctcctaaatagtgccttgaatcttgtcagttttcaataattttgcttaaggcattgattgacgttagagggaaaagtcaggaacaaaagaaaaaaagacaggattttgaatgtttgtctggtaaaagagaagctcagcacccgattgatttcataacatctgatcatccttcctcagttttctaggcttcagattctctttccaatgcatgctttttacaaatgtatccactttgggctggatgtggtggctcacacctgtaatcccagtactttgggagaccgaggtgggtggatcatctgaggtcctgaggtcaggagtttgagaccaggctggcccacatggtgaaaccctgtctctattaaaaatacaaaatttagccaggtgtggtggcaagcgctgtaatcccagctactcgggaggcagaggcaggagaatcgcttgaacacaggaggcagaggctgcagtgagctcagatcgccccactgcactccagcctgggcaacagagaaagactccatctcaaaaaaaaaaaaaagtctccactttgtaaatgttaatatgtaacattatgccttaaagcacaggtcatcctgaatggcaggcttgttttgtcgtttgtccttgttaactcgggatgacattagaggtcagagtggattaggaaaatccactcatgggttaaaaatgattggaggaggtgagggatgggaagtgtcctgcagacacagaaaggatgtgtttccacctgcagcagccggcagctgctctcgggcaccgtgtctggacatccttggggaaaactgctgctcggtctgtcctcacagacggcgctcagacccctccaggagacgcccacgtgcgcactcacctacgtcacaagcagcctggcagtgcctcccactgtgtgtgtgtggcaggggtggggtggtggttgctttgcactctgatgaggggagcagattcccttcaagaagcacttttatcagctcttcctgtgcactaaaggaaaataattgactgtaacggacaaccaattcctgttgagggagagtgttagggagttcatcctctctataaaaataagttatagcctgagtccaggccaaggtgcctcatgcatttttggtaggttctaagagttatttaatacagtcatcatctccggatgcatttattttgctttggtggcctgtccagctgtacagccggtggtacagaatgccccatgcaactcgagtttgggaggagactggctggtgacggccacaggtgagcgtggcctggcccagctcagatgcatagagctggcccctttccggtggtcttcctacaacttaaacctatggagcctgtacttatagggaagcaagtaagtttctgctattatatattttctccgttacagaaacagtagctattcgttataatgatttttagaaaaacacacaagcccaagagcagacagtgcccatcctgtcactcaacagccgcgattaacatcttcaggtgctggtgacctcttctcacacacaggtttcctgtacaaatagattccatcttgacctatgcatagtttagcatccggcgtgcttctgaacctagtgtgatagaatcagcattttccacgatgacatgacctgcgtagaaatgacgccatgcctgtgcgctgtcctgcggggacacaccttgcctagctgtgtctctgctgctgggtttgctggtatttttaaatgatgccatgcctgtgcgctgtcctgcggggacacaccttgcctaggtgtgtctccgctgctggatttgttggtatttttaaatgacgccacacctgcgcactgtcctgaggggacgcacgttgcctagctgtgtctctgctgctggatttgtcggtatttttaaatgatgccacgcctgcgtgctgtcctgcagggacgcaccttgcttagctgtgtctctgcagctgggtttgctggtatttttataatcctgcactgttacaggtatattcatgtgtgctgtctcactgtcccctcatttcacgctatttttttaggctagacgtccaggaacagacttgctccgtcaaccacagggcatgggcgtggggaaacagtagaccacaggctgacggggaagaacacgcctgttgacttgggactttcttttcttacagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtagctgctcttggccgcccgtcagggcctcgctccactcagtcctgccaatagcctagaataagccaaaacccaaccagcggccctgggtccttagcactgactgtaaccccagcagggctgtggaatctgagagcagggctgtgcgttcgccttgcagacctgccagcgcagtgagtaggtgggagacccccgaggtgatgcggaccccagtgcagggctgaaggaaacccaggggttccagctccctgtcccctgccaccctgaaaatacactccgggccacttgttttccaagggccaaaggctgcctagagagtatggagataacactgttttgatgctttaaaggggagggtttctgttgaagtctgatttttcaaaagcttttcggtattgtggccaaagaattgagtggggaaaccaaaaggtgctgggaatgaagaggtaaaaggaagggcatgctctcctctctacagaaattggacgtgctcacagcaacttcaggtgctggcaggcccctcagctggggtcacagatgttgcatccatggtttcagaccacagacggttgacccgccgtccatctgggcccccagatgtctacccatgatatagacgtggcagacggttcctttccccgtgaatggagagctctggccggctcctgcccacgctgcacctccctctgcaagtctgttttaggtgcagtgttgtgcacccagggaggccgggagattgtcctgtgatctgggtcaggtagcgcatccctccgggatctggcggacgtggttgagcagggctggccgtcaagccctctgccaacacggcccacctcctgcttccttttaccccttcattcagcctgcgttcctcggagctttaacagtcagattcttgattgccgctggggcggcccagggaggagggtgagtggagcgtgctgagagccgggcccgtgcggcgctggtagctaggcatgcgggcggagagagcaggggagccgcccgctggtccagggcctccgaaccaggtctccacactgtggcttcattgttttgtttaggattctgaattcccagagcatcagccatacccaaggtcagatgtaagtaccgaaatgtgctccaaagccgcgtccgcatgactttcattttctctcccttttttggatgttcatgcgaccgctcttgtcgcctctgtcctgattctatgtgccaggcactatgctgggtgctcccatctgtcccccttagatgaggacaaggggctcaccagggtccctaacctgcctgcagccctgggcctcgctgggctccggcgccggtaagcaggaaagctagggtgccatcgcccgtctccgtctccgtctccagggtcacgtctgcagtagagactggagaggcccccaaattagccaggtgacttcccattgccagacactcccaccctctctcttttctcctcagccacctcccacaggtgccctccaggatatccacccagccacgactgaggcagtgccaacttctaagcacgtgcagtaccgactttatctgaaatgagtgggacataattttggaaactcatacagttaagtcagcacgctcggcacagtgccgccgcttcctgccccgcccacagccaggaccccacacccctccgtggtcagccctcttccgctcccagctcccacccctggcatggcagcctctgctgagtacaggcttctcctcatccccccagcttcccctgcaaagctcagcctgtgcctttaccccttcccggaggcctctctggaccccagccccacacactgtgtcctgtgagagggaactgcacccccagcctgttgccaccctgcacccagcactgtgcctggcacatagggagtgctcagtaaatgttgggtaagcgagtggacggatgggtcgctgggtgcgtgctgggtgaggatggatgcaaagacaggaatgtaggtggatgacgaagtcacctttcatggcagtaagaaaaaaaaacgcacaacatcctgtgtgttttctgtgcatcctgtgagctggcggtctcacaattatccaaaggaagtgaattgaaaagctacagagaaaatgtagttggagcagctccagtgtcaggataaggaaaacagccaaagaattgaagccactgcaggagtaaaggggaggaaaagaaggaatcgagcagatgaaagacgggttccttctttcagggaggcgtcaggaggggagctgcagacggcagccttgccagggcaggaggtgacaggctgggacaagagtgagcaggctgtggacaggtggccacgtccctgccaggcaccatttaatccttacaataaccctgtgtgctggttgttaattgtgcccagactatggatgggaaaactgaggctcagggagggtcagtgacttgcctaagggctcacggccaaggccatgagtgaaggcagcggccgagactggagcctgcactccactccacccctctctgctctgcttctcaaagaggagaaaatcccagaatgattccgtgccctcaggagcctgccctggttctgttcctgttctgggacacagggcaggtgtcacgctgttctgcagctcatagacaaagctggctagcccgtgttccaccagcattcaatgggactggcttccgggacctttgggcacagttttgtctgagtgcagatagcaggagaatctgtgttctgcgaatgtcattcctacaaatgaacagcgtccacgtcactgaacacatcttctgtggagctcacgccctctgtgagtcactggctcatggagagacagctccaggagggtcctgtcccggggtggggggtcctgtcccacaatgcaactcccttgttcacagtgcattgcatgaccttttactatcagggtttgaattcaggattctcattataattactgggctacgtctaacgtgatccctaatgagtgagggtcctcagctcacacctcctatggcccccgtcctccttccctgcccagcttagagcagaagccagcggcaagtcccctgttcctcagatgtctggccccggccacctgagtctggcccttacagcaggactcacagacaggtctcatcacagctccagatttgcaggccagatgcccgtaggagagaatgggctccagccttggcactcataggccagtcctaggataaggaggagagcttgtgggcatggctgagctacctcggagacgtcctctgacccggtctggcctgacctcgcttttcttcattccaattggaccatttgtgtattcactttcgtttttatcctttgcggtttgtctctcctgctaagttttccattctcttttgtgtgcatgtgtgtgtttggggaactctgggaaatgtttacagctcccagatactgcggttaggagggacggaggcctggtctaacattcagggtccttctgtccctggtgccttgtgaatcccacctttataaatgagatcagtttttttgttgttgttttttatttttaattttttttttttttttgagatggagtctcactctgttgcccaggctgaagtgcgtggcacgatctcaggtcactgcagcctccgcctccacctcctgagttcaaatgattctcctgcctcagcctcccgagcagctgggattacagacatgtgccaccacgcctaatttttgtatttttagtagagatggggtttcaccatgttagccaggctgctctcaaactcctgacctcaggtgatccacctgtctcagcctccccaagtgctgggattacaggcatgagcctccatgcccagccaaggagatcagtttctattctgtgatctcaccaggttgtgagaaggcaggggcagcctggaaaagactctgcggctgtccattctgaatgtcctgcctgtgataaaagtgtctgcctgattctccaggcacacaggcagctgctcttcctcatggctgccccagagctccaagcctcacaggcagctgctcttcctcatggctgccccagagctcaaagcctcacaggcagggccggccactcacctgtagctctgggaggcagagcacgtctcagagggaaataaacaggagtttgcatcagattcagggcacctgccctgctatgtgtgaggtgttgaaggaagagcggaaaatgagcttgttgggagagcaaagattacagattggcaccctggcccagtattactagtgagcggttcctgctgccagccccgcccactttcattttctcagcagccctacagaagctgggctcagaggaggctggttggctttgacgccgctgctagcctgggactgcatgggaggtgggacagtgattttgctcattcatctttttttcttgcacccatatatttttcaaaactttaagagatgagggcttgctgtgttgcccaggctggagtgcagtggtgcaatcaatcacagctcactccagcctcaaactcgtgggctcaagtgatcctaccccctcagccttgcagagcactgggattatagatgtgagccagtgtgctcccactgcaattctagtcagaatttcctttggaaaagactcttgagttacctttccattgtataaaataatttattttctttgtcccagacttgcttttctgtctcacatgaagcctctctatgcccaggatttctgaaattgataaatacttagctcctcctggccaagtatgattttaccatgtccccttcagactttaccatccagcaatggagaacttcattttacttagaaagatttcataaaagacagccagggtaaaatctgcacagttcatcatatgcgtgtgcctttaatgtaatatacataccactattcacgtgaccgtccttaaagctgggatgagagaacagggaatttgcatttgctgtggacgaacctacttgagtcaggcctcaggctgagagttttacatcagttaactgaggcattgggtgtcccctctttgaaacaaggaagcaaagattcaacaaaatttaaaagagtttcctaagagttgcatggccagcaagtagcagaatctgaccagctccaaaaactgtatttttcaaattcactataaaaaataacaaaaatatattagaggaaatttggagacagaggaaggaaggaaaacttccttttacttttgttatatttttctttttcatggtacacaaacatgcctgtgactgcgagtgtctctatgcttgtgcatgcccctggtcattgttgtccatggcacctgtcaacctgtgttctttaaagtctgtattataagcattcttgaggttatctttagaaccatctttattttttagagacagggtctctctcactttattgcccaggatgtagtacagtggtgcaatcacagctaactgcagcctcagtgtcctgggctcaagtgatcctcctgcctcagcctcccgagtagcttgtcccacaggtgctaccactcagctaatttctttttttgtagagatggggtcttgccatgttgcctaggctggtctctaacgcctaggctcaagtgatcctcctgccacagcctcccaaagtgctgggattacaggcatgagccaccatgcccagctccattgttttcactgctgtgtagtattccgtgtcacaagtaaatcatgacttactgcacattcctatcccactgtatcaccctcattctccccaggtgctactttataaataatgctgcaatgaacacctcacacactggtcagaatttaaggtcctttgtttaggctggattcctagaaatagaataagtgagagagacaaatattctccacatttttatgataaaaacgagtgttccttttacaaaatatctttaaaagtattcatttatttcactcatatcagatttggcaatatctaccaaaattataaagtgcaaatacctctgacccagacctcccgtctggtgaatatattcagagaagttttcacacaagtacagacatgtatttatatagcagcatcatttataatggcagaaaactagaaataaccaaatttcccctgcactgaaggctcattaaatgcactaggctatactcataaaatggaatcctttgcacttaaaacacgaggcagctccatatgtacagacatggaattttaaatgtattaattgtattacaatcctttgcgtaaaataacactgatcatgtttatgtcgagcaaggtaaggtttaataaagtcgtgacccacttaacactagaaacgggaatggtaaattctgacaggaaggccaggatcttcactcaagaatgttcttcctcctgtagcccgtctcacccagctatcagaacacgcatcccagtctagggtcagcttctgcaaacacgcatcccagtctcgggaccgcttctgcgcctgtcttcagaattacacccggtgaaagtggacgtctctgtccgttcccctggatccacggcggcggccgagagctccagggttttctcgcgctctgtcttctgtgcggcacccggctctggggtcagagagatcccggcaagagccctagccctgaccccaaccagggcgcgctcctgagcaagtcacccccctcctctgatccgccagctctctcctggggctggaaacatccttggggttattgtgtggagtacacgtgataacgctggaacctcagcctagtgcctggcgcagggtacgcaccaaataagtcttcgctgttaccatcagtacctctcttagccacaaatctgagccagtcctcgttgacacaggcttaaccttaggatagtcacaaagggcaactcaaatgttaacgtgcagctcctctctcttgcctcacaggggacagggtcagaaatatttcatgctttgcaccttttccttgtagtgatcagtaatatttttaagaagggagagattttataacttagctatgacacttcagagagggctcaaaagtccttttgatacaataggtaatacttttctggaaagaggaatgactgagtgcctggaatcatatcaatggcttaactaacctttggtttcacagttttcctacttggtttggttttgtttttttttttttagagaacgtactgtactagaattcccttgtgggataacttcacatagctgatgatcattgcaaggcttgttgggtttgtggggactttttggcaaatacagccacaatcagaattctctgtggaatacatgatttctgttctgatctgacgtcaccctgctggccatcctcttagcagacgtgagacagctctatggagatgaaggtggagagtttgcctctgtttctgatcagtgctgaaattcctttctgtgtctttctgtacgtggatgcagccatcagtataagtcttttaaatcgcttatttgttgtcattagctgtgtttggttcatgctgtactttcttcaccatagggcgtgataagagcttttaagtcctgttataatgcagttcaacaacacctattttttgcctgagctgaactaagcagttttatttgcatacatttagaagaccaaactgcagccttgagttcaggtagttatgtaaaatgtgatgagacgcaggagtgatgtaattactccagtgtgaatgcatttccctctctgcggttttactgggtcaagtgcaccgctgcattaattaaacaaatgcgtaattaattacagcaaatccacaacaacaacaaaatagtcccttgcccaggccccatgtttcagttctaaaataagacgttctctgttgaattaggtggaaacggccacagattctgacacggagagccgcggtctgcgggaataccactctgtcggggtgcaagtggaagatgagaagcggtaactcagcccctcctgacacgcggtgacccccgagcgagggctctttgtcaaaggcctgatggaagctcctagatcctgccggccctcaatcatgcctgtccttgtggaaacagggccatacgtttatacttttccattgataaccctcaagtatgaattaacacccgcctatgtcttgtttttgcaagaggcaagggagtaattctttccaaagtaatttatcacctctgaaagcagagcagctgacggcctgaaagtcagagtccttgatccaaaggaaagaaggacgggctgagggtgacgccaatgcaggccttacgccttgtcatgttacacgtaaaacgatagaaagacagcaaagcacgttcaaggccttcatacaccgtgaaattgtttcacttcaaaaatattacctagaaacaaaaaatacaaagtgatatccattagtgttatttttgtaacaaggcaggacgatcattttagtttatatttaaaatagcatgtattgtctatttcataaaaacaaattttgatgagaatattacatggtgagggctcagccaatgtgtgacagggacagtgttgggtggcctccctcatcagggagcgttttagcacccaccctatggagattttgattgcaaagaaattccgaccccagcttatggcttccccagtttccaagagacctcctagaacctggccatcttctgcacctgggagccgggcaggctgccttccatcctgctctgtggctcagtgtccctccctgtgcccccagcaaagggaacacgtggcaacgtcactaaccagctgcatgcacagctgtgtgcttctatgggttcagcctgcagagccacagggatggctgcagtagctgggactatgtagacacagagagacacacacacaccacacaggcacacgatacagagcatacccacgtgcacacacacgctcacagtgttctcacccagcatactggtctccaactgtaagccccctcctatcaactattttggtgatcagctatgtggaaaagatgacattaaaatatagacagtgaaaatgattttccaacacctgccaaagtcagaatttggagtcattattttgcatacaggggttaatggggacatattaaattatccagacagaagtggctcaggccctgaaacacaatttggaagccactacaactcagtatgatgttactattgtttacataaaagaagcaacccatggctttggctgcataagctcgtagcatatttctgaaagggaggtagccatttgctaatggtggtttcaagaaacacgttaactctcattgtatcattcaataaacttaaatcccaagtgggtgttatttaggcctgagacttaggcagatgttaaagtataatgatttgcaaaaccaaatgttcttccacagacaaaacaccagcatatttcacaaacaaaacactacctgcccttgagccgccaggctgttgagctcaggtgcgctcctgacaggcgacatgtaggactttgttgcatgaagtcctctcagaagggctaccatctgtcttccttccctccttttgcagacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagtatatccccctcaattctaagaaaagatataaattacatgaaaagagaagcagtcactacgatatcgaaggaaaattgtgtgtgttttgtcaggtaagttgaatagaaaatcaactgtgctaacagttttcttgggagcatagttgatctcatattccacttagcagttctcttgaattttggcaaaaacttaatttgcagcatttatgttattttctagaattgttaccagctcatgctttacaagaaaatgccttggcattatgccaaagagaagtcgatggtaagtaaaagattaagttagttaactgtgtgatgatgtgctcaaaggtctcactcctgggtggaatgggaaggccgtgtcattcctctaccagagtcaccaccaaaggtctcactcctgggtggaatgggaaggccgtgtcattcctctacgggagtcaccaccaaaggtctcactcctgggtggaatgggaaggccgtgtcattcctctaccggagtcaccaccaaaggtctcactcctgggtggaatgggaaggccgtgtcattcctctacgggagtcaccaccaaaggtctcactcctgggtggaatgggaaggccgtgtcattcctctacgggagtcaccaccaaaggtctcactcctgggtggaatgggaaggccgtgtcattcctctacgggagtcaccaccaaaggtctcactcctgggtggaatgagaaggccgtgtcattcctctaccagagtcaccaccaaaggtctcactcctgggtggaatgggagggccgtgtcattcttctaccagtgtcaccagggcagatctgtcccagtcccgttggtactcacctatgcctctgcttctccacatggaaggggacagccccttattctccgcctttctcccatctgcctagagaaacctaccatcaagaccgttcaggccaggcacggtggctcacgcctgtaattccagcactttaggaggctgaggcgggtggatggcctgaggtcaggagttacagatcagcctggccaacatggtaaagccccatatctgccaaaaattcaaatgagccaggcgtggtggcgggtacctgtaatcctagctatttgggaggctgaggcaggaaaatcacttgaacctgggaggcagaggttgcagtgagtcaagatcgtgccattgcactccagcctgggcaacagaatgagactctgtctcaaaaaaaaaaaaaaaaaaaaaaaagagctcagaagcagcacccattataaattgctgtatttgattgacttctaagctaataccacctgtctttgtttatagaccaattacataattgcacaatacctacaactaatgcttatgtttaacacagtacaatttcacaaagctatttctgaatgtcttgacaaattacggtctaagtatttttctttttctgtgaatttatttgtacattgacaagatcattataaatgctgaacttcaaaaggatagctgagatccttgggaatttgtccctgacatttcatttctagatggctgttttaatagggcattcactaatcctagaaatagaagtgcaacaatgaaactacattgactatgacttacagagaataacggccttggagcctcggcagtctgagaaaatcaatggcgtgctgattttttattgttaaaacttaaggtctgaacctatgaagaaagaaagacattgcctttaattgactaagcctgttcttccacatttgtctcttaatcatcaaatcccacctattctttacaggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaacacagaaaaactgcattgcctaagttgacgccaaattaaattgccagctctggttttgtgcatgctgacaggggcagcgtagggctggggtgccttccttccaggatgagagcaggtgatgagacctgcatgtcactcaatcaagctgtgttttctacaccatgtgtttcctcaaaagaacacctttgaggaggaggagagaggaaaaaatttaggagagaggaaaaaatttacaaagaggtcatgtttgtttgtcagggcttagcccataaaatgcctataaaattgtatcctattatcatttgagtttatcccattcgggacacattcagaaagttgtagtcttctttggaaggtgtaagacattgagacattagccattactgtgttgataacacagagactacttctcctgtcatcattttccatgtttagtgcatactttcaatttcattttttcaaggattatcatttttgaaaagatatcttttaaaaaaaaatagaatcctcagctgggcacagtggctcacacctgtaatcccagcactttgtgaggctgaggcgggaggactgcttgtgcccaggagttttagaccagcctggacaacacagtgagaccttgtctctaccaaaaaaaataataataataataattaacattttaaaaagtagcccggtgtggtggcacatgcctgtagtctcagcttctcaggaggctaaggtgggaggattgcctgagccccagaggtggaggctgcagtgagccgagatctcaccatcactgcagaacaagaccctgtctcaaaaaagaaagaaagaaagaatatctagaccagttctccctgaacacatatgatatgtcaggccctgtgccgaatgcactgcagacctcattaatgctcatcccaatggactaggtgagtagtattgtaagcattctacagataaactggggctctgagagattaagatcttgccccaaatcacagaatagtagcggtgacccgggactgggagtcacggccctctgacgttgaaggctctgccttcccagcagtgatctgggactgggagtcacggccctctgacgttgaacgctctgccttcccagcagtgatctgggactgggagtcacggccctctgacattgaaggctctgcctttccacccacggtccaaaggcatcaagtcaagaagttcccttatgggaagcaccccctccactgcctgcttccatgctggatgtgcatcccatcctttcacctgctgtttcagacaagggtgtgtcccatccctgacccttcacctcattctggtcctccacgactgtgacccacgtgtggtccacagagtccctcagctgcgaagacagaggccaaggttctcccgcgttagccattggaaaataagtggcaggagctgtaaggaggcaaattatttctcaaaccaagaatgaaagtccctacaaagggctttagtgctgaggccctgtcatggtaagtcctggttttctgtcactggaggcattccagaatattctataaattatgccataaaaatactacatacaaaattgaatttgatgacgtatagggacccaaatcaacagtaagattccaaaatcttaggatatatagtatttttttttttttgagagggagtcttgctctttctcccaggctggagtgcaatggcacgatctcagctcactgcaacctcagcctcccgagttcaagtgattctcctgcctcagcctcccaagtagctgggactacagacacgcaccacagcacctggctaattttgtatttttagtagagatggagtttcaccatgttggccaggataatcgtgaactcctggcctcaagtgatctgccccccttgcccttgcaaagtgctaggattacaggtatgaaccaccatgcccagccaggatatctagtatttcagtgtcacttaccttattattaggcatctgaaaaactatttttcttcagtaaggtagggtggaaaattaatttttgctgactccaaattatattcccctaaacatatgtttggtttcgtggtgggatttttgttttgttttgtcttgttttttaccttttttgagccatcaggatcctcctctggactctctcagtgatgtctacattccatagatatttattgattacttacgacgaagcaagccactctccgatagacaaaaatgatgcaacaatgagtaagacatggtaaaggacctaactgattacctaacagtgggagaagaccaggtacaggaagtggaaactgttgagtgtcataagagaagtacagataaagtacttaaaaactcagaggtctcagcaatgctttcacctgggaagattctcagaaggcttcctggagaaggtggcactgtgctgggccttgacacgcggttggatttggtcaaggtggtggatggtggtgactgaaaaggagattcaagagtccacgcagaggcagagaactggggaacagaggcccctttgtctccttcctctggaggaagatcttcatgtcagcactgcccttcatcctgcctgtggggagggtctgtgctacctgacctcacagagccttctgtggccggggcattccccataccctgggggatgatggaacttgcctaaagctccgcacctctgctgtcatttgagattttaggctccttcaatgaagtggccacatttgacatttatcatccacagacagtgcctcacacatcgcctggcacagagtgccagacaataggaatggggaggaagagagggaagcaggaggatgggctgtcttagcgaacaggatgccacactcctgctcacacctttataaaagcagaacatctagactcccagagaatcacctcgccatcctcagttatggaggctgggagtagcttcaacacttcccattctatagacatccactgaaatgatcctgattttccttgtctttgctccactatatatatatatatatatatatgtgtgtgtgtgtgtgtgtgtgtgtgtgtgtgtgtgtgtgtatacacatatatgtgtatatatatatgtgtgtatatatgtgtatatatatatgtgtgtatatatatatatatatatatatatatatatatacttttttttttaagacgaagtctcactctgacaccaaggctggagcgcagtggcgcgatctcagctcactgcaacctctgcctcccaagttcaagcaatgctcctgcttcagcctcctgagtagctgggattacagctgaatgcccctacacccggctaatttttaatcagaaaatgtaactgcattgctataaactttgaacacaaggaacagagaatggatgaacttgatactttttgtgattttcttaatttcttaaattgcccagataccttcatctttttgtggacagatgtcaaaacacttgttatgcccctcatctgtgtgttttgtccataaaactagcacaatattcatcaagttcagatatttccctaaatgtttaaaaggtaagatgataaccttaatttccagtcctaattttaggagcagatacagggttattggttatggtactttttaaaataaagattaaattaaatgtcttatgagactaaaactctgatctctgaatattgaaatttccattatatgaagtaatttttgcccaaaatataatttcataacacagttccccgaactgattgaatgaatctagattcagtcagtcttctatggttaataaaatctatagtgaacccaaagaaatgctggtctgcataaagtcacattaatgcaggctgcctattgttaataaaagtactttcaagatattaaatcattagtaatgttttaagatttttgtattatgtcaaaccaaatgggtaaatacataaaggaaaaatcaaaaatgtgcatattttctaaaacaaaagaaatccttcccaagctaagactttattgaataattccattgagatgcaactctcatcaagaactcaccaagggagcacatgtacacacaggatctttcaaacggtatcggaaacttccttgccccaaatgactcctcccgaagtaacgaataacctacatgttcaccgggtcagatgcacattcaaggcaaacactaatgctgggaggaacatagggatttgctcactaagttctccttttacagccagaatgaccacaagtcctattaacacaagagccggggtcagatgtgtgactttgtatctcctgggccatcttccatgctgagacaaaatggtctggatggggagaagcaccccggcagttggcactcacacagcggtcagcagctgacaaagagcccagagagactctgagaatgagcagaacacatgctccatgcagggcacgaggatgacatggccacagagaactgtgcctgtgtccatggttggcccaggtggtatcagaccaacagagaagattgaggaatcagaaatactgatgacgttctgagcacagcagatgcctgtgcacatattggcagctaccagccttaggggtcaatgtatcacacagcttaatggaacgtccactgcttccagacctcctgggagatgcaggtcatagactgtgtccattttgtggatcagactaagagaatcaacccactgaccaggcctctgctaagcacctatgaagatgttgccatacaacccaactaaatggtcatggggaaatcagacaataaaaagacatggatgcttgtcagcacaggaaaaggaaacagcagagtgaaaagacaactcacagaatgggagaaaatgtctgcaaactgcccatctgacaagggactaagaaccagaatatacaaggagctcaaataacagaaaaaaaaaaaaattcaaaaatgggcaaaagacctgaataggcatttctcaaaagaagacatacaacgggccaacaggtatgtgacaaaagattcaccaccactaaccatcaggaaaatgcaaatcaaaaccacgatgagatgtcacctcatcccagctagaatggctattatcacaaagacaaaaaaacagcaaatgctgtcacaggtgcggagtaaggggaaagcttgcacactgctggttggaatatgaagtagccactatggaaagcagtatagagatttctcaaaaactagaaatagaaccaccatgtgatccagtcattgtcctgctgggcatagacccaaacaaaaggaaattcatatgtcaaagggatttctgcacccacatgtttattgcagcattattcatgttagccaagatatggaagagacctaggttcccatcagtagaaaaatggataaagaaaatgtggtaagaaagtaatgtgtgtgaataatattcacagtggaatattattcagccataaaaaaaggaattaagtcttgtcatttggagcaacatggatggaattggaggttattatgttaagtgagataagccaggcacagaaagataaacactgcgtaatctcactctgatgtagagctcaggcgggcgcagtggctcatgcctgtaatcccagcactttgggaggataaggcaggcagatcacctgaggtcaggagtttgagaccagcctggccaacatggtgaaaccctgtctcaactaaaaatacaaaagttagccaggcatggtggcgcacgcctgtaatcccaatcccagctactcaggaggctgagacaggagaatcgcttgaacctgggaggcagaggttgcagtgaaccaagatcacgccactgcactccagcctgggcaacaagagggagaccccatccaaaaaaaaaaagcagagctcatgaaggtggagagtagattggtggttaccggaacaggagagaggaggaagagaagttgattcatactaatgggtacaaaaatacagttaggtggaagaaataagttctagtatacaatagtacagtaagaaaacatggttaataatgtatcatgtatttcaaactagctagaagaattgtaatgttcccaacacacacacataaatgtttgaggtgatgcacgtcccagtcatcctgatttgatcttagcacactgtagacatctgttcaaatatcatatgtgcccccaataatatgtacaactgtgataaatccattaaaaacacacagaaacgtgctcaaaaacatgaaaatcatgaggctcgagatcttgaaaggagatttctgggagccatagcttaggcagaccccactacaaaattagttacaagggaatctcaggggatcacaggggttacaaatactcaaatgatcatttccgactctctgcaaattttataaaaatccatctcaaatattagaacaccagaatagtgtgaattatgttacttcataccaaatttagatagaattggaattatagaaaaaataaaagagccaagtgtgttaatcaaatttctttgtacatggaaggcaagggttctagcaggttctttgtgaatttgcattctgatgagaattagtccttagtatagctcctgcaagtgtctaaactatggcaaaattagagacatatactgggagagaataaattgaattttcacttcaacttctttgcaattataggaagctacttacattataggcatcagataggatcattctcactcactgaacagcaaaattctcctaccattagcaggcatgtcattagctacactttttgacattcattatctctccctagcaatattcaatttattccctttataataactctccactacattaaatcgataccaagattttgcccatgtgttcatgttgtgttaaagagtataaattgaagtactttgtattaacagttcagttgaattccattttaaggggaatgtgaaaattgggaattaaacttcaaattttaagaaactgattgacttttaaattacagtttgaggaagcatagagttggcaaaataaattcatttattcatccacttctatatatttctgcagcaacgacttacttaaaatagtccctttaaatatcttcattaattacccaggttttagaatacaaaagaaatagaaattcaacatttcaaaagcaaagatgattcctcccctcgtcatcagcgagtccagggctgcagaacacgttcattttgggggcagtggaatgcacaggaaggatgaggagctttcactgtcacccctgtcaagaaaccactcaaaccccaccgcctccagctgcttctcgaccgactgcagcggcccctccactcccctcacccccagactcaccccaactcagagccctgccagctccatcccgtgccatgtggccaggggctcctggcttccttctccagtcctcccctcccttctctgttcccaggctggctggtaaatcagatccaaggaagagcagcctgtcttgaagtggatttgtgaacggcacaaggccccggtgttaagatgcccgacagacaaccttccatccttcttttcaagacagaaacaatgccaaagtgttatccgagttacttgcttttattaaaagttatgcttttttcatctttttcataccctagaagcaatggagaattaggtgatattcaggaactattgtcaccttcgtgggggtgacagtggccctgggtctacaaggtggtcgcaggtaaaggcctcaggaagagagaacacaggacaacacttactgccgtctccacggaatggggagggagctgtgggttatactcttctttcccattttctgcatgtgtgaaaggtttcataataaaactttggggagcaaaacaatcttcattttagaaaaataagacaagacagaaaaataggtttttaagtccattatcctacccaggagaaaatcactttgaagaacacatggtacagattgccagaccttcatgttctaaaaaatgagggaggcaccgcacacactgctgtgtagttgacttctgggtcacggcgtgccataagccctttcaaatcaaggttatctctgcaacgtcattttcaactggctcatagcattttattacatgaacattaagaccctttgtgcccatgaaatgcggttctttttcccgaaagtcgggctaaggaggagacactgcagcaccctggcttgggcagcaggatgccagtttctggatcgtgtgcaatgaatctcaccagtaactgtctctaggactgactgttaaggaatgtttgggggaagagctgttgtggaagaacctacacgaggattgggttcacttccctggacctcggtttcgacttctggaaaggctgtctaggcttccacagtcaggtgtgccctgggagccagcaggggcatctcctaaacgtagaaagaaacggactttctggcccgacccggaccccgtgagtcaggccatgcccggcacaagatccccaggtgaggcacaggtgggtctgcaaggccccttgagctccaagcacctgcatgtgtctaggcaaaacctccagcacatcggtattcccttgtgaagtacgtaaagccacagattaagtggggatggatctctcgcctctgcgttcaagggggcaaatctccaggataaatgcccccttttcctacaccattttccaccagccttggagagtcagcttcccatggcttccttccaacggaagcaggagaaagggctgggctagttaaaccgcagcactttcagttttagggtgtgtcgtgtaggttagtgatttgtgctctgcagagactctccagggagagcaaaaagagcaggtggaatcatcagcttggccagaagacgcagatgacgccccgtgagccagctcaggaaagacggccccaccttgaagggcccacgctgaaagccagtgatggggagacgtggtgtgaactgagaggtgatgagatgcgtagatcatctgccccctgcctggtgggcagccctggccccacgtgctgacccaggcacagaaaagccacatacgtgtactgggcacgctctatggaagaacggtgaattgttgctctggcaaataatatccagcagagatcagtgggcccagggtgcactggtaagaaatgggttccagtcgattcctgtgtggttttgaggatcatggtgagctaggatctaccaaagcagctgtttacaaagtggtgaccatgctgacagcagactcaagagagggtgtggggccgggtgcggtggctcacgcctgtaatccttggccttgggaggccaaggcgggctgatcaccggaggtcaggagttcgagaccagcctggccaacatggtgaaacgctgtctctactaaaaatacaaaaattagccaggcatggtggcatgcacctgtaatcccagctactcgggaggctgaggcaggagaatcacttgaattcaggaggtggaggctgcagtgagccaagatgacgccactgcagtccagcctaggtgacagagcgagactccatctcaagaaaataaataaataaaacaaaataaacacacacacatacagtatattcttttaaaaaactttacagccaggcacggtggctcacgcctgtaatcccagctttttgggaggctgagatgggtggatcacctgaggtcgggagttcgagaccagcctgaccaacatggaaaaaccccatctatactaaaaatacaaaattagccaggcatggtggcatgcacctgtaatcccagctacttgggaggctgaggccagaaaattgcttgaacctgggaggtggaggttgcagtgagccaggattgcgccactccactccagcctgggcgataaagggagaccctatctcaaaaaaaaaaaaaaaaaaaaaaaaaattagtatttgattaaccaaataaagtcattgcaattaggaaccatttgtagattaattcttcctactgaactgtggcctgctgactcatagcacactcagaaatgtagcgttagcattacacatatactgggtacatggattggtgagtttagtagctgtgagcatattcagtaacttgtgacccttttaccatctccaggagggaagccacatcttcctacgtgctacgaccttcctgtgaggcctctgtccacgcagcctcttcctacgtaacacacacctcacagcactgccaggagataactgcccacagttcattagaaattatttaattgaatccaatgagagaacccatatggatgtgttttttctaaaaatgaaggaattcacatctaaaagagttcactaacatgttagagtccataaaaataggaagaactcgatgttgctttcactcacacgtgttcttgtgtcttccagctcatccaaacagcagcactgaaataatctcgatgccaaaataaggaaaactccctgaggtataggccgcctttctaaactaagtttctcccagtacccaaggagaatgtcctcacagtgacatctggtcatctctggatttccttcatgagttggggacgagcacactaaggcacgagtcaccagcgaacacgctcggcacgatgaagtcgtcagttttcatctccagtgggactcgctcccttggtgtgatgtttctgcttttgtgtaattgacccagttttgaagttgttgtttttttgtttttgtttttgttttaaacagttctcggtaaaatcaggagtgctgttgggagtgcccagcttctcatgtcccagaaattccagcagttttattggctttgccaacagaatatggtaagtgaatcctcagtgaacccctgttccctgtaaccaagctaatgggcatcattccacagattctcattgttttcttccttgtcaaagagttcccatcggtatgcggaatatcacgtgcacttactacagaagaggcttcccgccctggggaaagagacgattcggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggtggatatggccctggtttaagcagtaccgaggcagggaggctgcaagggggagtggaggacaggaagaggcgggctgcagcagcgcggcgtgacactgtgtctttgcaactggatgccccaccagagcatcttagaagaggagaaacaagggaaatttctattacgtctaatgtcacaaatgaagaaaatgatctaaggtgcctggaaataaaaatacataaacaactacaatgaagagattaagaagagattttgcaaataatttagcctttgtattttatagtcggtagtgaaacgaatataccatgaactagatgattaatacagttgacgttaaacttggttattcctgacaagcaaacaaaaagaaaaaccacatatatatttacatatacttacatatatacatgttaatatatacttacatatgcttatatataaatatatatacacatattaatatataaatatatatttgctatttctggcagagcagaaaagctcatatatacatctcatatatattagatgtatacaagattataatcatatgcatctatatgtttatatatacacctatatataaacatatataggtgtatttatatataaacatatatattaacatgtatatgaaattttacttatgtatccttatatatacatgctaaacattaacatataacaaatatataacattaactacatattttatatatacaaatatatagtatatataaaatatatagtatgtgtgtaggcaaatatacagtatatataaaacatgtaagtttacatggtaatatattttatatatacatttgcctacacacatgcatacatatacattctatatatactgtatatctaagtttacatatacatgttaatatattttatatatactatatatttgcctacacacatacatgtatacttttccttggctgactaaagtattcactattttgagaaatagtaaataatagttatgctacttaataagttgttttataatacatacatcgatttcttttcagaccaaacattttcagtcaaatgcaaataggtcttctctaggcctcgcgtagcaatggtgccaggtgttttgatgatgttttccttggctttttcacgtgcaaggagacataagaatattcttacacatcaaaggatgcacaagcaagccagagttgccatctcatgtcttttccttaggatcattaaaaagtatgccttctctaatactttccaatcaaccccactgaagttcacggcgattttaaagagtcaccaacacatcactctgacaaagttataatcatcatttaaaagagggaaatagaaaggttttgagtgcctcgaaagaagcctgtaactgtgtaaacattcagctgccatgtcacctgtgaacgttcttgcctcctccatagtatctatttgattattacctttaaaggaattgattcgggccactgacgaactctgtgtaacattatgcagactcgggtgagcctaggcaggcactgtctttaggaatgctcatccaaagcttcccacacacagcccaaggtgcatattcagacctgctaaatgttcctttctgctctgccagaaatagctaatatttggcttaaaattgttcatcctaatatttgttatgccttttgagttttaaaatagctggcttggctacatccttttctttcaacttctattcaggattagtagaaaaacactttgacacgtttggggcggaagagtggtacagggaggggtggtgcctgagacaggcctggcaggagaggagtgttgacttgttaagagatgcttcgctcatcaaagccaaatggtccgcagcgcaaagtagcaccgctgtctgctggaagttgttggtaggtaactaagctttaagtcaaagagcgaccctagaaaatgtcagaaccccagcccgagattgaggactgaccacagggagcggagcctttcgggacggaccgcggggggcagagcctctcagggtcgggatgtgcaggtggcttgtgacacaaccagaaggcacataataccggaaataacttaacctcaaagcgtgtggcctgattgctgtgcttgtgggaccagcagtttggtgtccccagaaacttagtctcattcacacccactgagcctgcctctgaattttaactccatccaaccccggggggtgtgtgcctgagcaggtgccggcgcacagagagctgccccaggccacacggggcaccgaagttcctatccaatggacgccggatgccagagccacagagctgtgtgaatttaaaagacggcaatttcacaaggaaagaggccctgcatgagtttgctgggggaaagggaatggcatggcacaaccattgactttttttttttattataaacaccttatcatctctgaatgttcagtggattcagatgcaaccacctccccaaccaaaagagaacagaagacaaaaccaaaccctgaccatgccaggctgtgcccgtccggccccagcatgtggtctgggtgagcccaaaggacgggtgtgttgttgccgaggagaggaggggggcacgggaaggcgatgcctgctctcaggcagcctctgccacagtggccggccatgttcctccttcatcccccaggagatgtgaccaggaccacccagctgcgggcgagggaggagaagccactccgcttcccccacaccatcaggcacagccgtgcccggccctacagaaagaggggcacagccatgaccggccctacagaaacagggggcacagccatgcccggccctacagaaagagggggcacagtcatgcccggccctacagaaagggggcacagccatgcccggccctacagaaagagggggcacagccatgcccggccctacagaaagagggggcacagccttacccggccctacagaaagagggggcacagccatgtccggccctacagaaagagggggcacagccatgcctggcactacagaaagagggggcacagccatgcccggccctacagaaagggggcacagccatgcccggccctacagaaagagagggcacagccatgcccggccctacagaaagagggggcacagccttgcccggccctacagaaagagggggcacagccatgcccggcactacagaaagaggggcacagctgtgcccagccctacagaaagaggggatgttcttaggttggcgaagacttctggaagccaggtaggaaccacccctacagcctctgagcagcctcccctgctgcttgtcacctggcctggcctgccctgaggctgcagctcctggcatccctcgactgacttcggtgcagaacgtggcctccttgccaggcactttagttatccccacccacagaggctgagttcgggctcccagccgctggccagggccgccctcctggggagctcctcaagtgcctgggggggctttgagtggccaaggctgccctcgtgtggctgcagagaagaatgggctcagccgcgcggagggcagctgggggccccaggtcctggctctgggtgaggaatcgcagagctgtccgttcagcatgctcttcactgagcatgctgagtgtgcactgctgaaaccataagcaaatccagttgaatgttgacccaccagaacctcctctgactcttttaaatccccactgaatcaagggagccacacctggaaaaatcattcagatttcaatgtagggagcaagccgggcacggtggctcaccctgtaatcccagcactttgggaagctgaggcaagagggttgcttgagcccaggagtttgaggccaccctgggcaacacagccagaccccattgctacaaaattaaagaaattagctgggtgtagtgacctatgcctgtggtcccagctacttgggaggctgagcaggcaggatcccttcagcccaggaggtagaggctgcagtgagccatgatcacacctgtgctccagcctgggcgacagagaaagaccctgtctcaaaaataacatacataaatgtaggcagctggtggaaatcatgtatctgtcaggcactgggcagagaaaccaagcacgtctctgggccactcggcccagggctgcagcccagcagcgtcacctgtgcctcctaagtgtgggcgccggttggtgagagcatcctgttccttggcgcattacatttgtaaggtgtcatcaccgtaagaacgagagctaagagccgtcagagaacaagcaggtatagaatgggctccaagctggttccccactgccaccaccaggccaataccacggcaggctcacggagccctgtcccttccgaatcatccacaggtgaccaaaaacacaggctcctactgcttttatgagctgtgaagcatttagaaactctcccatctgccccattcccagcattttcaacgtggaacaatgaacagctgtgctacgtgtttttaggccgacagcaaatacgtgtgctaaagtaaactgtcatggaagcatggccttcccaagtatctgcctcaggctggaattagccaggcttctccctaatccgcctcttgaaaggcatgcgtggggaggagtggcctccccagccctgtgcccgcaggagactctcctggctctgaacaccctgtgtgtgtccccaggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggtaagggcatccatgcagggccggctcccagcaaaccccctttctcactgcactaacgacctgctgcagatagagcatgacaacggggttctcagtcttttgctggcaacacacgagcaaatttccctctatgtatgtgtgcacatgtgtatacgcacatgtgtgtgcgtgtgtgtgcatgtgccgaaaatggggcagaattgaagccttgggcatgggtggtaaataatagggtctcccctgctctgtctcttctatataagcctttcagagagacactagccaagatcacaagcaaacctgcagcctcattcctgacaggggtctcacctatgaattatctttatcaaacttgttctcattgtgtaaatattaagctggcttcccacagggaaagttttaggcctggttatggactatctcctattcaatataccttctagtatggccactataggcaaggcgacattttataccttattgaaccgtttgatgaattaatcttcctgtagatccatcagcctcaacccttaaaataggctgaaatttgccattaaatctgaaccctggcatttcacttcttccgtgatgctgtcatcagaagaactagtagatagttctgagttagcagcaaagacatagatttcctcacacgttttaaagacgtcctgaggaaccataaatggatttttctagacaaatgttattaattaaaatgataaagaaaatcaagtcagcatcctttggggaagtggtgtttggtatccagcaaggatgcacacctgggtcatgagaacgagagccagatctagtggtcatcatcatcggctcctcccagaaggtgccctggccactagtggagttccaggccagatgcaatggatccacaggttccctctcatcccagacgacaggggagtgaggtgggagtgcacagggtccacgtaagccatgcgtgggacaggtccacataagccatgcatgggactaggcaggtccacttaaaccatgtgtgggacaggtccatgtaagccatgtgtgggactaggcaggtccacgtaagccatgcatgggacaggtccacgtaagccatgcgtgggactaggcaggtccaagtaagccatgcatgggagtaggctggtccacgtaagccatgcatgggacaggtccacgtaagccatgcgtgggactaggcaggtccacgtaagccacacatgggacaggtccatgtaagccatgcatgggactagacaggtccaagtaagccatgcatgggactagacaggtccaagtaagccatgcttgggacaggtccatgtaagccctgcatgggactagacaggtccaagtaagccatgcgtgggacaggtcagtgtaagccatgcatgggactaggcaggtccacataagccatgcatgggacaggtccacataagccatgtgtgggactagacaagtccaagtaagccatgtttgggacaggtctgtgtaagccatgcatgggactaggcaggtccacataagccatgcaggggacaggtccatgtaagccatgtgtgggactaggcaggtctgcgtaagccatgcatgggactagacaggtcccagtaagccatgcatgggactaggcaggtctgcataagccatgcatgggacaggtccatgtaagccatgcatgggactaggcaggtccacataacccatgtgtgggactagacaggtccgtgtaagccacggtttggatctgaggtgaaggagatgatcagtgatgctcctgagggagaaggctgttcaaacggaacgtactgaagttagcccaggtgcacacgatggttccgtctagtctccattctttggtcattgagagcaaacgtgagcccatctacccaagctgcgcatagagtatgattctcaaaatggaaacgtctttgggaggccaaggtgggtggatcacgaggtcaggatatcaagaccatcctggctaacacggtgaaaccccatctctactaaaaatacacaaaattagccgggcacagtggatcacgcctgtaatcccagcacttcgggaggcctaggcaggtggatcatgaggtcaggagatcaagatcatactggctaacacggtgaaaccctgtctctattaaaaatacaaaaaaaaaaaaaaattagccaggcgtggtggtgggcgcctgtagtcccagctactcaggaggctgaggcaggagaatggagtgaacccggaaggcagagcttgtagtgagccaagatcgtgccactgcactgcagcctaggcaacagagtgagactctgtctcaaaaaaaaaaagaaagaaaatggaaatggtttctcgctgagggcagagcacgccagtccagaaagcgagcagatctccagcacagcagaggctccgtgcctgaacaggaggccctgcccctcctgaacacggcgtcttaaaaattccctgggatgggccctgcacagcatctgctggacactcctacagtgccacacccacaggcctggaagctcctttgattggggaacccccacaggaaatactgatgtgtacatctcacaggctcacagttcaggggacaccaaaagaggaaacagatcctcttctctccttttctcttggcatcccctgaactatgaggacagttatgtgctgaaaaaaggaattacttgttaaagtagctgaaggtttcaatgaactgatcccccccattgttttagatggatgccaagaagtcaggtaagagtcattgcttctggcctagtcacgtaaaacaagccgagggaacaaagttccagacaccaaagcaggcttcttgccacaggcctcctccgtactcacacaactgcctgtcttcccccaatctacaagcacctctgggctccctttggaatttttcagaggctgaagagaaaaagacatgagtggagttttcctgtttttctcccccaaaactagatatctgcttaggaaagtggttctgacgccttctgccgtgtgccctttcctgggaaggaaacagctggctacggagagtccctgtcatggctctgtccagaaggggagacggggcaggtcccactgtctttaggaacaatgtgaatcacggggcaggtcccactgtctttaggaacaatgtgaatcgcagagttagggacacagaccttttgtgggaacaagtgcaagcattaccctttgcatgtgttgcataattgtgagatttatctaaaacggcatacacgtattttagcgtgacttatctgagagtctgagctaagggtgagaaatacttgcgtctttttacaaagcaggcaagtgaatagtggttttataaatatcgtccacgtcaatgggattttaggccaattagcgaatcgggccagtgtttccccgcacacccattcacgtaagatggttttcatgaacatactggaatcccagagtctgcagaaaaccctgcagtgttgaatagggatgtccagcgatggtgtccaaaaccctcgcgatgctcggagatgacacagggctttgggaagcgcaggaatcgggcgacaatgtcagactagcgcagtgactgcagagacgcaaggtgcgaatctgcagaatttctttcctgatttgtccacgctgcccctgacgcctctgccccctttggagagtgcgagggagcttccacaaatcccatcctgtgcagaaggcaggcctgtggcctgggagccggggaccagggcagacgggggacgggagtgaaggatgcggccctgggggctgcggtcgggaagggtcaggccaggccccagggccgctgagctcgcgagctgctgggaccctcctccgagcacctgccaacggtgacttgcgctgcttttcaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 2401 - DNA, 314599 bp, Homo sapiens
ggcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctggtaagtgcgcggcggcggtcgggcgcggggacccggggccccgggccgggcggcgcagctgacccccgcccctccccttcaccccgtgccgggagcgagcctccattcccgagggggaggctcccgctttcccctttgtggccccccagcactcctcttcacccccctggcagtcccccgcgctcagtctctcggggtcccgggatggggatgggggctcagggccggctgcccaaccagcctcgaacccattgtctggctggagaggcacctcacggcgcgtgtgcccgggaggtgcggcgtgggcgtgaagagaaggtggcgcgggctgggaggaggaggtggcgagccgcttaggctttttttttaaaaaaaacaaaacaaaacaaaacaaaacaaaacaccctgagcccctgcggaccatccctcgggcggccagcccgggacctgcgaagtccccggcagatggggcgcatgtggccggccgcgggcgccgcgccgggcggtgagcggaggcgaacttggagggctcacgtcgcggcttggccaaggggagcttccccgaaagggaaagcggagacccacagcagtgcggcgccccggcccttggcgaggagcaggggcatctgaaacccaggccggggagaacctcagcgcgttccctctagacttaaatcttaaaccacaaaaatgtggagttttgcggggacgtgttgcgagctgtcctgactgcacgggcgacccctcccctcctcttgcacgcccagccaggtcccccgctccctcctgcattccgcttctcccagctttccagctcctcaaatccaggactctgaaaactcccctctttctccctttcctgctgggacagtgtctgggcccctcccagccgaggcttgtgctgtgagctgcagagggtgtggcggcttgccccagccaggatctggactgctgttggtcccccagactaccagttttagtgtcccagcctcttctaagggatgttgggagggacacacacaggcgagattgggctcattcctactcctgacacttggacacttctcttttcctagttggttacctctaaactccacaagactaggcagcaagggaaactcgtgatccgggcagccaacgattgtgcctgcctgcgggttttcttttcttcttttgttttcatgaaaacttagaactttggcagaggactcgagttctagatcaaaaatcggttttctgaggtgtgctcagctacaggacgttcaaattgcctgccttcaggccttgaaaaaggaatggtttggtatgggaagtgatgttctggatggcaggttagctgtgtgctctttgggagaactgagctctctctcccgccacctggaaactctggtgtggccgtcggggagacagatgaggttgcttgtgttgctttgcatctcctgtgatctcccacagctgctcccaccgttgtgcaagatgggacactgaaatgaaacggcctaggcataactctcaaggcggcctgggtgcatacttgacctgcttttccagagacaaacgtttttcttcaaaaccctcttcctactagacatatggttcttacctcctggctctggctttttttcctcctggctctggcttttttgtttttccatccatgctgtggtgctctgtgtgtgtgtgtgtgtgtgtgtgtgtgtgtgtctgaatacttgtggtggaggagccagtgacacagggaaaccagtgcagcagccataataataacaataatgcaattaagttctgcttgactaggatagcatttttttttgcttgagctttcatttaccctgctgattaataacacatggtgtgaattaatctttagaaaaataatgtcccatcattaacatggtggatttgtgttcttgttaaggctagcagttgcaaatatagtatttagacaattatgattgtacatcccaagcttcttggggcagggttgttgtggctacttttacactactgtgtgtcgcagttactgggtgcaattccttttaaaattgtttacaatattctaagcctctcaatcaagaaacaaaaacaataccaggctgaccttttattgagtagagacaaagcttttgggggaccaggtcagcttgggaaccctcttcctagggacgcatttggaccattgatgcgttccttgtcccaggtcagctccacttgctctttgacaatctgtgagaggagttgaaaccttccagatcatctccgtgggccaatagaagtgcgcagtgttggtgatttctcttgttttttttttttttctggagttgtgtgtgtgataatctcaactttgcttttcttcatgagttgcttaagaaatcagttcaaaccatttaattgtggacatcaatcttgaaggacaagttttaagtggcagatttttaagtatgtatgtggagggcaatggaaattgtgttggcattattgataccagttcaactttcttgtataataaagatcatacgggtgttttgggaggaaaaccagatagtaataccgtatagaaaagtgtctaagcacctcattgtaagtatggctaacatcaataattaacagactgtttcaagctaggagaacagttcctcccaacttccagctctagaatatttaaggcctcagagagaagtaaacaaaaattaaaatgacaaaagtccattttatttcttgttaggaaagccttaagagagaacaaatctattcaatgactataccctccctccccatcagtttatatgggttaaattgtgcgaatataaaaaattagtgggtatgaatggaaatgagagaataaaagactaatgaattaagactagaggggtgaactttgaaaagtaatctttttaatagaaaaaaatggagttagtgactagcaaaaattggatcccagtgttaggagtttaatcctcccaaggataggtatcttcagtatcattatagtaatagttataaaacttacatttaagggaaaaaattactgtcttagtgtatacatttaaaccatttgcttccctgtattgacctttcaggtacagctggaaggtgagatacacacacacacacacacacacacacacacacatatatgcatatgcctttgtgtgtgtgtatgtgcaatgtttctgttatactctaacctatgtataatttatatggaagtgtttcataaattataaagtcagccacgtacttcaatctttgttcttttaggatgtaaggatgtatatatttcataggtaatattagcctgtgttttttgggggttcttcatatctgtaatagccatgtggccctccattgtatttattaaccattgtctaattttgggggttacatcaagcttgtcaaccactgcctgtgggcctcatgggcccaacgcaaattcataaactttcttaaaacattatgagatttatttcatgatttttttttaagctcatcggctatcgttagtttttgtgtattttatgtgtggcccaagacaattcttcttcttccaagtgtggcccagggaagccaaaagattggacatcctgggttacatacacacatccacaaatactcccatgtcttttatttttaaagatgatgataagaaggtggttctgggtggatgtggtgaacaactgatggtttttgtccgagaatacctgtttctacattagacactgcataatattattcactcatttttggcttgcagtcactgtttacaacttaaaaggcacacccttggatgcctttgttgaagagctatccttaaaattcttttgttgagtttcagaggaaaggacaattttaagtctgtgtcttagctgctgtatcttgtgcaatatcaggtgtcaggcagcactgcaaacagatttaaaattattaggaagtaatggtttagggcagtattatatttggtatcaggaactgctttggtatctgattaatttgagtccatttccttctcattttttttctgcatgtcctgagattgaatgtggtcattttgttttaggaaggagtgggaacattttctgagtatctactatgagtaggccttttacatgttctcatttaatgctcacagtaactaatgctatcagcaatactatagatgcataagtaatgattatttaggctgggcacagtggctcacccctataatcccagcactttgggaggctgaggtgagaggatcacttgagcccaggaattcgagaccagcctgggcaacatagtgagatcctgtctctatgaaaaaagaaaaaaaaagattagccaggtgtggtggcttgcacctgtagtcccacctacacaagaggctgaggtgggaggatcatttgagtcctggaggtcgaggctgaagtgagctgtgttcataccattgcattccagcctgggtgacaaagtaagaccaggtctcaaaaaagaaaaagatatctaagttgcctaaaattatacagttattaaataaccaatctagtctttcagcagagatttggatctgttccctactccccctggcctttcttttatattatgcttccataggcttagaactgggaagaaaaaaagggcctgcgactagcagtaaaaaattcctgtctggttagtgcaaatttcagactggataaagttggcagaaattcttcagaagtgactgaagtgaggtgcatttgaagtttcttctctttagatgtcaagccttttggcatcttcactgtgctcttctattttcaagcatggagttaaaaattgatctggtccaaaaaggtgctcttcagtttttcttttcaaggcagatttgaaataccttggctgaaaagtttgttctccaaatcagaaggaataggcaacctgtcagtgcaacgcatatactccaaatgcgaaacctgtgaaaaggaaaggaaggtcaagttgttgttttttttgtttgtttttctttttgagatggagtcttgctctgtcgcccaggctggagtgcagtggtgcaatattggctcactgcaacctctgctacccgggttcaagtgattctcctgcctcagcctcctgagtagctgggattacaggtgtgtgccaccatgcccggctgatttttgtatttttagtagagatggggtttcagcatcttggccaggctggtcttgaactcctgacctcgtgatccacctgcctcagcctcccagagtgctgggattacaggtgtgaaccactgtgcccggccggaaggtcaagttttaacatttaagtttacttcccactgcaaggtgttgctccctttcagccacttccaaggaaagcacttgccataaagtctgttaagcagatgggcgggtgggagtgtagtgaggccatcagatgctgctgatttgtattctcacattctttctcctgttgtgaggggaagagagtgtggaagaggggtggtggagtgttggcactttgaaccattacagtttcaccctaggcagtaactccctgagctgttttattctccaaagtgggaatatatggttagggctgttatcattatcaggatgcattttttcctcctaataataccagtaaaaactgtgacaatatattggggtatctaggatagaagttgatcaaatgcaaatgtttggctccaggaagagactggcaacagtgtaaagtgatgaaatttggggagagatggtatgcgtggccttaaatccgtaagtgataagaagtactttggcttgtggcctgtcatttagcattggcctgggaggcaggagacctagtttctagaatcatatttgctgcaccaacttggacaagtgaaactctttcctctggcccttggttttcctcctttgtgaatgggaataaaatttggcacaattgttaacatagtcgtgagatgatggaaatcataccacttgaaaacaaaatttccagaacataatacattgtgattcattagttgacattggcttttgaagagctttcaggtggaaatgtgtgtaggggtgttctgtgtggtctaaagagtagaattccccagggtcagtgactgaaagtcatatgagcatagggaaaaatattctaacatgtagagttgttgaaaatggatggtgagttctccgttaaagttattcagataatctgtgtgacaaacactggtgattggaaggccctttgcagcccaagaagataggaagtacattattggctcgaaagttgccctctttgaggtgagtctgcaacttgcaggttctagacatagaattataacacctgagagtggggaaagatctcctggtaggtgcttcctgggcttaaagaagaaaaagatacgtatgggctgatgtttgttctggaaattcatttgactttataagaactgttgcttaaagggtttggtcttaatgaacagtgctcttctttttcatatttagagcttggggaatagggacaaggtaaagtgggctctccagccctcaggtttaagcaagtaatagatgtcaaaaaagtagctaatacaagaagcactgattatagatgattgcccctcctttgcaagaggacgctgtaactggagtacttttaggaacaaagcattgaatccttataaaagaaggaacagcctagaggaacttaggagggaaggtgagttacaagctatacagttgcttggcagatctcatcttgtagagcggctctttatggagtgccactgccatccctgcaaataagaagtgtgtccctaggctttggagtcatggttccttagagagccttcatgtaccttcttagttctcacctacttgaacactggggacagagatagctcattgcttgtcttccctttagaattccatctgttcatactgcagggtgatcttcctccctcctccccagtgaccccttcctcctttccagaaacctgtctttcaacataaatgccaaggactatgcagtttccaactgatagcatataatttggaagcaatgtctaagggaagagctgttaggttggagagctgcctcttgaactgtgatctcaaccaaggcccggagatgtggaccagacgggcttggaattctgaaattgggcaacattcagccctatttaccaggtatgatggtatttgatgttgacagataaaaatgtacattcttttcactctctgaaaaaacaaacagaaaaacatgaccatcagtgttcactggtaggcaattatcacaaactctctatgatttctagtcttgtatagtttctaggacaaacttcatatagtttctgtgattccatgatcttcagtgttcttgtttagcctgtaattgactttggtgactctcatttcacatgtaaccttagtctccttttttctttgcagaagttctgatgcatttgtaagcccctgtaaccattgccacagaagctgaaagccttgaggtgtttagaccctgctatccccagaagtaatctcacttgactgacttctgtgcatagaagatgcccatggcttggttttgggaatgatgtcaaatatcaaatagttcatatttttttgttttgagatggattctccttctgtcatctgggctggcgtacagtggcgtgatctcagctcactgcaacctctgcctcctgggttcaagcgatcctcctgcctcagcctcctgagtagctgggattacaggcacgcaccaccacacccagctagtttttgtacttttagtagagacaaggtttcaccacattggccaggctggtcttgaactcctgacctcaagtgatccaccagtcttgacatctcaaagtgctgggattacaggcataagccaccacacccggcttaaatagttcacatttttgaccatgtgcctggtgctgggacactaacgtgtgactgatggtgcttttaaataacacatctcactagtctcaagacctgtcttggttgagggtttgctcaggaacctgacttcccttccttgttttttttctctccgtggaagtttggcagaacaccttatttaagctagaataagggtattggtaagttaaagtagtggttctcaaacttggttgtgcattgacatcacttggcgatcctcagaaagtacaagtgggccaggtacagtggctcacgcctgtaatcccagcactttgggaggccaagacaggaggatcacttgaggccaggagtcctagaccagtgtggagcaacatagggagacctcatttctactactaatgaaaattagcagatgtggtggtgcatgcctgtagtcacagcttacctgggaggctgaggcaggaggattgcttgagcccagaagtttgaggttgcagtgagctatgatcatgccactgcactctagtctgggcaacagagcaagactatctctaaaacaaaaacaaaaacaaaaacagaaacccacaaatgcctgggttccactcccagaaattctgataaatttgtctggaatgtgacctgggcatcaggatttttaaaagctccctagaaggtttgaatgtgcagccaaggttgacagccactgtgctagatgttttccccctttttcttcctaccccaaagaccaagccaatttgcctatgagttaaaaccagcagaaaacaagataatgagtgtaatagaaaagggattgtttaagaagttaaacaaaattttggatagattaggcaaaattgagaaggttgagaagagttaaaaaaatgaaagatatttgattcaactaaaagcaacaagatgaaaaaatacagaagaaaaggataaatcctgttgaatggtagagagactttatttaactatttaagaaatgaccaccaaattatcataatgaaaatttgtgagaaaattctatacatatggtgtaagattaagcaatgacccagaagtatacttctggagtagaacaatcaataaatcaattgcatttttgcttaggcctccattctgtagcctaattgtttgttggttcaatgcagcccttttgctttgatctctggttttaccatttacaaagacttgatgagcttggcttcctgtagtgaaattcaaatatacttgtgaaatgtaaacaacattcatttattaagaatcctataatcaaggcaaattggcatgcttatataagcaattagccttgagaatagaaagataaataggatgctaggtcaagaatgagctgattgttctcaatgcaagactctagttatttctttattcattataatgtaagcaaatagacattcctcttattcataatttttagcatttgtggtttggggtttgaggacagcatatgtggttttctggaactgagaggatagtagcaattattgtttcattttgatttagaaatataaatcaatcttataaggaactgtaggtagttgatttatgactagataaaactttctaataatagggaacagggcaagagagggtatggatttaaatgggaatagtaaaggataataatagttttattttggtggggaaggtaaagaagatgacaattttacagtggcagaaagattgaaaatagtctcatctgccctcattgaataaattgaataaaaaaggaataacattcttttttttattggcatagaaggaagcattatgataactaatagcaggagaagttggatatgtcatgatcagatttgcaccatggcaacactcagttttgcccagtgagttcagtactgctaaatgtcttatttgtgaaagctagagaacctaaaatgcaaaggcagtgaattgggtgaatagctttgttaggttcagttctggccctttcattccctgatatggtcacctttgttgttcttccaaagaaattttctctttggtgacaatggagtatcttgactaatcagggttctttattcccaaggacttctgcctggtgaacctaggaagccaaatgttttgggaccaggatgccataaacttggattcccagggccttaccataaagtcactctacaccaactaatttggccatccagatgcgaacctggagaagccatttagaactctgtggcctcctgggcttgtgcagcccttcctcttgccagtgtttacaccctccagtggccttttatagcagaatgtttggtttggttctcagggtccactttttggaaagcattgtttggcttagaaatctccagatcatttgtgaatttaccaggtctcatttctcatttaattaaacaagtctttaacattaaacacctatagttttttttttctttttcttctttttagatggagtctcactctgttgcccacgctggagtgcagtggcacaatcttggctcactgcaacctccacctcctgggttcaagcgattctcctgcctcagcctccagagtggctgggattacaggtgcatgcctctgtgcccggctaatttttgtatttgtagtagagacggggtttcatcatgttgcccaagctgctcttgaactcccaacctcaggtgatccgcccaccccagcctcccaaagtgctgggattacaggtgtgagccactgcacctggcctatacttttattatttcaccagtaattatcagaagttctggcagggtgtggtggctcacatctgtaattccagtgctttgggaggctgaggtgggagaactgcttgaggcctggagtttgagaccagcctgggcaacagcaagatcctgtgcctgtgaaaattaaaaaaagaaaccacacacaaaaaaactggcttagtggcacactccctgtagtcctagctacttgggaggctgaggtgggagaattgcttgagcccagcagttcgaggctgaagtgagctgtaatcatgccactgtactacggcctgggtgacaaagtaagataccctatctctaacaacaaaaaaagttccacgattgatttcctctgatgtttctaatgataatggagaaatttaaaaattctttcttggtcattttttagaatgatattacctgatcctcttttaaaaaaatcttttcatggccaggcacggtggctcagactgggtgccatggctcatgcctataatcccagcactttgggaggccgaggtgggcagatcacgaggtcaggagttcgagaccagcctggccaacatggtgaaaccccgtatctactaaagatacaaaaaattagctgggcatagtggcacacacctgtagtcccagctacttgggaggctgaggcaggagaatcgcttgaacctgggaagcggaggttgcagtgagccgagatcctgccacagcactccagtctgggtgacagggcgatattccgtctcaaaaaaaaaaaatttttttttcacaaaccagacacagttgcaaccaactcccagatcaggaatcagaatccctccctccctcttgttcttcaggagtggtgagacttggcttctggtctcccagccacagttattgctcacctgaacttactttctcagcggtcacacttcatgtggaagagagtaggccacaggattgtgccttgtggtctgactccaagtgactctaaccatgaggtttccaccacttcctttgagagcattcctagtccaagtaggcctgagcattaggaaatattgacactgcagcattttcttgttgcttttagttatatcatcattgatcaccttaatggtatttttgtttgtgtgtatagtatccctgcttttcataatactgagaagaggatattttgatttgtgttcccaaagtaaagcatgaatggggagggatggccacagagaaaatgagcatttgaaattttgggcattaatacttggaattacggatatgtaggtacaaaatttatgtgctccttctcaagtgtaagttctgacctttagcttttgttatctttcttgatgactcttgaaatattaaaaggtataagactgtgaatttcatgttctggttcaatttcccatcacagccctattgtgttattccagacattattaatagataaaatttgaggggctcatggccacgtttgttggtctctcttcttttctctgctttgtaactcctgtatccctcacagccttcttcctgaagccagctacgacttggccagacccatctcctcttctgtttctttacaagtccctaacttggaagttttttttttttctttttcgttttttaatccctgtccccagattaggcctgtgctttctctccttcgtatttttttcccccggtgattcccctgcataggatgggctctcttcgcttctctgcttactgaaactataccagccttcaaagttttctacagtcccactttttccgagggtccttacagacccacgtcagcatgggggtgatgagaaaaacaactctccttactttgatcgctttgtggtatgaattatctcttactcatgaggcacttgattaaatatcactttgtataacttctgattgtaaaatagggagatgctttcatatgtagctttgtagttgctcattacattcttagccatttgtttgtgtctttgtttcacctgccagttcacactgtgggctcctgaaaggcaaggatcatgtcttacggggtctgacagcttttacttggcttagccttgggaagggtcccagcaaatgattgctgacttgataagggaacggtgcccactgaaagaggactgggaattggagtggctgctctggatacctatttaactgaccacactaggctgactattaattgcacataacttgcctttgtgttgaaatgacacttggtcatagattcttattcatcttggtattccccttatcacttgactgtggtaggtgtccaagaatacgaaacattcagagacaacaagttggcatcatgcttccctgactccttgtgaattagcagaagaggaggagggcagtttatattttcttttttgttggagtgaggtaagtttaaatgggcagcgttctttgttttggcatgttagtgctttgctgtttgcagagtgctctccaattgtcttctgtgcttctaagggtttttttttttttttttttttttttttgagacggagtctcgctctgtcgcccaggccggactgtggactgcagtggcacaatctcggctcactgcaagctccgcttcccgggttcacgccattctcctgcctcagcctccccagtagctgggactacaggtgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacttctaagggttttaaataaatgagacaaatagggcatgagactggatggcttgaagttatataagaaggtggtgaagtttgtgatccagtcctaggtcttcatactaaaactccggggtgcattccactgtaaactaatgatgtttatgaattctctcgagttctgttaggtgctttatatgcattatcgttgatgctcatgacaacttttccagggaggtattgtcttccttttactaatgagacaatgggctgagggtgttaacgtggccactacccaatcctgggggcagagtttgaatccaggcctgcctgagacagcctgcttctttctactgcactacactattatgttttctgagttagctctaagatgtcattaaatgtatgcttcttgttcgttcttcacataccctctgtactaaactcattatttcatacaatagctgctttgaatgagtccaacttgtgttatatgctgcaaaatctgaccttaatctcaagggactcaggatgtagctggggaaacaagcaacaataagcaacccagagagcttcataatcagtgtagatgtagatatgctaagggtttggagggaaggtgccttttctgaattctgagtgttcagaaaatgtttccttggaataggaagtaggtgagattctagctcagtcccaaccactgctgggctgcacttttcattctacattgtgcatttttgctcctttggtgcttatatgctttattcagacagtccaaaaaatatttcttgagcgtttactgtgtgccaggcagtgttgtaggcactggaggatgctgtactgaggtgggatcgattgaacgtctgctcccaaggaatttacattttaatgggagggcgtagagggggaagccagacctgaaggggatgcacaggtacagaaatggagcgtttagatggtggaaagtgccatgaggagaataaaatgggatatgtgaagtggtgtcatcccgataaggtctgagtgaggaggagcaggcagctagtgtgatcaggtaagagccctcgggagggaggagtagccagagtacgatttgtttctccgtttgctggttcaggagcagtttccagggaccctggagcaagtgaagggtcattccacagcatatgggatatactcagcccagacagcttcagaccttgcccatgggacagcctcaaggtggaggctcaggagtctgtcccctcactctgttgtcggtaacagagccatttcttataggtggttttgtgtagtcagagttctgcctcttgttaaattcaggtgattttcaaagaaatgagtatttcagaattgccattgttctagacccatgggacagactgtttgagaatggactgtttgatcagtgtgagctgtgccctaaatgcaggcactctgaaggccagtacttagaatggctttctttgtctgcttgaagctataggttgacctgggacaggcaaggtattacggaagagaattactttattgctgttaacttgctactagcttgtagctcagattctttccctctttttcttttttatatttcctttacaaaattattgtattttaaggggcatacaagaattttacaaagaaggctgggcacggtggctcacgcctgtaatcccatcactttgagaggccgaggtgggcagatcacttgaggtcaggacttcgagacccacctggccaacacggtgaagccctgtctctattataaatacaaaaatcggccgggtatggtggcgcgcacttgtagtcccagctacttgggaggctgaggcaggagaatcgcttgaacctgggaggcggaggctgcagtgagctgagatcacaccactgcactccagcctgggtaacagagtgagactctttctcaaaaagaattttataaagaggtgcaattcttaagataaaaataaagtgaaagttgtgtatagttaaaattatcccaaaaatacctgaagttgcccatgaaagtacatgttcaattctgtagtgaaacaaccctagaaagcaattattatttcttttaaattttactttaagttctgagatacatgtgcagaacgtgcaggtttgttacataggtatacatgccatggtttgctgtacctatcaacctgtcatctaggttttaagccctgcatacgttaggtatttgtcctaatgctctccctcccctttcccaccaatcccagcaggttccattgtgtgacgttcccctcccggtgtccatgtgttctcattgttcaacccccacttatgagtgagaacttgtggcatttggttttctgttcctgtgttagtttgctgagaatgatggttttcagcttcatccatgtccctgcaaaggccatgaactcatccttttttatggctgcatagtattccatggtgtatatgtgccacattttctttatccagtctatcattgatgggcatttgggttggttccaagtctttgctattgtaaatagtgttgcagtagacatacgtgtgcatgtgtctttatagtagaataatttataatcttttgggtatatacccataatgggattgctgggtcaaatggtatttctggttctagatcctggaggaatcaccacactgtcttccacaatggtggaactaatttacactcccaccaacagtgtaaaagcattcctatttctccacagcctcaccagcacctgttgtttcctgactttaataatcaccattctaactggcatgaggtggtatctcatcgtggttttgatttgcatttctctaatgactagtgatgatgagctcctagaaagcaattcttatgcgtgttaaagtttgagaacctttaagcatgattaaaagagaagccacaaaagaaaagtgggcaattctgacttagaactctcagacctctagcagtgactggaggatgggtgggaattttggtatcttcctgcttgccagtaggtttacacaattcgatatcagaataagtctttaaatacatattagtggctttgtttattgtgaggattttaaggtagccctaatgtgggtttaaatgtggatttcatgcatgttcagtaataatacaatataggtcacttgtgtatttctttaatcgtttcagtaaacatgaatggtagctcaggaaacctgaaaggtaggtatatccctgtctcatatatgagaaactcaggattagggaagttaaaaatcttacctgagaacacatatttctagtaggtaataaagctgaaaatcaaatttctcgactcaaaagccgtgctcctaacattctgttttgactcccaatgcaaaaatattatgtaaatataagctatatgtagaataaatataaatgtttcaaagtaaattgacagccttgtgatggcaagctcatcatcttttcagtctgtgttcattttgttatatacccagaaccaacagtaactacatatccttcagaaaaattacagataaaatgagaactggatgaataaagccactgttcactattgaaatagtaaaggccaaataagcttgtgatcaaatcttttttttttttttctagtaacagttgtcctctgaaggctttctgaaggctctctttcagacaactgtctctgaacctttgtttttttaaatgcccctagtaaaatggctgtgttgttacagcttgaaggctgtgtggtaagcctttgctcagccctcagtgataacccatagacttggacttccatgtgagaagaacaaccattattatattgtgttagtaggccttgtgttggagattgcttatttttaaaaaaacaaatgccatgtgatcttatttctatttaaccaatgttttgcttgagtgtaccaagcaaggcctcttgagatgctgggacacaaaggtgaattttattttcccttttgcctttgagtagttaactgcctagtagatgagatactggaggtaagagaatgaagattataggatatttaaaggcatttatcatacatatatgtgttatgtttataatgtgctatagaaggacatattaaagttgaagtttctaatattttagattaagctgataaatctagacaacttactttggctgaaggttataatacataattgcatgaattctgctctgtgcctgaatgcttagagatttgagtgtgtgtctaggtatatctgtgcaaacaacttggaagaatctggtaaaaagtattaataccaggatcagccttttaggtggtaagagaatctaccccaaaggcagtcgactctaagccttacttctctaggttgcaagcatcagaaagtaagtatatgtccctatactcactttgttagaaagcccacagtcttttctgcaaagtctatttaacaaagcttgtttatgatcttggactttggactaaacctgagtttgaatcaggattttgctgcttactaattgattgacctttctaagccttggtagccacatccgtcatgagctcaagagctacctttttgacttgttatggatattaagtgatattgcttagtacagtcaagttgtggcagtcaggtaagcacctcacaagaagtggttgttctgattattttgtactcttttaaaatttgactttattaaagcactggctttagggtccaagctgtggactttaactggattctagtatattttacaggtaactttagttaaatcatcatcaacctcaaatgtgaagaacaagtgaagcagggcccccagaacgcccagaattgaactaatggtggcttgtatttgctactcttgccataagattgtacctactgaccttctgtgatacatcagtgttttcaaagttctggtccatgcatgcagccccacttggatttatgttgactcttgtatattttgttctttctagaaaaagagacccaggtgtttcagggcattgggctattccatttcagagcctaatggaagtgctagtgttttcataattggaacagacaactgccatgctacatatggtgctgtgaccactgagcagcttgttcacaatgagaaaatacattgaagttgtgaccatttgagccttgaagaaactgctgttgaagttttgtttggctccagctccatcctggaatggatggagtcatttggaattattctgaattccagtagtggcaaaaaaaaaaattgtgtaacttgtatatagatggttttctgtttgattaacagcattgttcaataaaagatgcattgttttaaatcaagaatacggtgccatctgacttgatctaggaggcacagaaagaagacattacagattacattccccagtaaacccctgcgttattttttccagaaggttctatattaatctgtttgggttgcgtcctacgtgatcttgctgagtcagacagagctaagcttatgaaacaaaggctagtcccaaatcaaataaaaacacaccaccatccagaaatgagagcctagaattttctaaagatgcacacatctttcttactatctggtgaggaaaattgctcatttttctctcagctgataaatatcacttttgccctaaatttttgtagtggcaatctacttttttaagttggtgagataaaagaatatttgatagcactgtcagactagtctgagataaaattctctgtgttctcagacccttaagggttcttaaattgcatgggcggaagctgtgtgcatgtttttcttggtgccctatttccatatcaaatagccttaatttttgtattttagtaatgaaggtatgaacccattctgtcaggcttcttatgccgtttattgtagcctttagtcagcttagaatagcatgaaaggaagtaataagccaactctaagaaggtccagatgaaaaggattataatatggtacaaaaataatagcatgcctggcctagccatgtgactcatttcttttggagtattccttttgacagcttttttgaatcacacatcaatcacaatgctggtatttttggcggggtgctagacgttactctaatgctcatgatggtaactgccaaaagtgaacaaagaggagaattataaatgaaacctaacagcatcacaaacatttattttttcttgagcagaaacaaaattgggagttagatgatatctttttcattgccccaagaaaaccactgctttattccattgaaaataagaccttgatgggtcatccccggtctttggcagtagaaactattcgtcttgtcttggtttccattcaggagctttccttcccaaaccttgtcccctgctttaggagtaatttttttagggctttaggtttttctcatgtcccagtgactaagcttgcttttgggtggttctctgtgctgcatgtagtccttctgggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttcctttctcccgctacagaggaaaattaccccgaattggcacatctcattcctatgcactcttgttaaaaataacttatagtttgcttctgaatttatagaaatggcactataatccatatgtacttttgaatctttatacatttgatttgagaagtatttatgttgatgcatgtggctttaggtcatttattttattttgtttatttttttgagatgaagtctcgctctgtcacccaggctggagtgcaatggcacatggcaacctctgcctcctgggttcaagcaattctgtctcagccttccgagtagctgggattacaggtgtgcgccaccacgcctggctaatgtttttgtatttttgtgtagacagggtttcaccatgttggtgaggctggtctcgaactcctgacctcaagtgatccacccacctcagcctcccaaagtgctgggattacaggcgtgagccaccacacccagcctggctagaggtcatttaatttttgaattatgttcattgaataaatgtgccataaattacagttgatcctcattatatgtgaattctggatttgcaaatttgcctatttgataaaaatgtatctgtaaccccaaagttaatacagtgcttttatggtcactcacagaccacaaagtggtgaaaaatttgtcaccagatgtgcagattctcagctgaggttgaacaaggtgactctgcttttttgtttcagcatgcatactgtacacgtgtatcctttttgctttctatttagtgccacactttttgcacttttgtgcttttttttttttggtgattttgctatttaaaacagacttcaagcataatgctgaagtgctgtccagtgttaactaagtgcaggaaggctgagatgtgccttatggagaagatatgtatattggtaagcttctttcatgcatgaatttagagagctgttggctgtgaggctgtgagttcagtgttaatgaatcaataatatatattaagtaatatatataacgataaatattaaataagtttaatatataacgataaatattaaataagtttaatatataatgataaatattacataagtttaatatatcacgataaatattacataagtttaatatatcacgataaatattacataagtttaatgtatcacgataaatattacatcagtttaatgtatcacgataaatattacatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataactatatattaaatcagtttaatatataaaaataaataagaaacatacatagcacagttttatgtattgatcagttgacaaaaatgttgcaaccagaggctctggggagcctaaccgtgtatttccgctagaactaatggttcaatggtcaataattcagtgtccatggtgactttatagaccataactgtgatggttaatatcgagtgtcaacttgattggattgaaggatgcaaagtgttgtttctaggtgagtctgtgagggtgctgccaaaggagattaacatttgagtcagtcaactgggagaggcagatccaccctcaatctgggtgggcaccatccaatcagctgccagtgtggctagaataaagcagacagaagaagatggaagagctgattcactgagtctgctgagtctgccgagtctgccagccttcatctttctcttgtgcccaatgcttcctgccctcgaacatcagactccaagttcttcagcttttggactcttagatttacaccagtgatttgccaggggctctcgggcatttggccacagactgaggcctgcactatcagcttccctactttagaggttttgggactgggactggcttccttgctcctcagtttgcagatggcctattgttggacttcaccttgtgatcctgtgagtcaattctgctaataaggccaggcgtggtggctcacacctgtaatcccagcactttgggaggctgaggcgggtggatcacctgaggtcaggagtttgagaccaccctggccaacatggtgaaaaacccctgtctactaaaagtacaaaaattagctgggcatggtggtgcacacctgtagtcccagctacttgggaggctgaggcagaagaattgcttgaacctgcaaggtggaggttgcagtaagccgagattgtgcctgggtgacagagcaagactgcatctcaaaaaaaaaaaaaattctgtgaataaacttccttcatgtatacatatatcctattagttctgttcctttagagaaccctgatgaatacaataactactgcaaataatgggagtcaactatctcttgtcatattgatggacatatgaggttattacaagtaacgttacaatcaaaatccttgtctatgtcacctgatgcacaggtataaatttcttaaggttatatattaacacttagaagtacaattgttgggtcttgggcatattcaacttaagtgattagtgttgaagtgctttctaaagtggctatatttccttgatgaagttggtgttagagaaattcatccccacagtgtacacagattgtacctacatattatgaaattagcaaaaaatttttagtacctacatggcactagatgtgagtactaacagtgagctgccatctaggagcttacagtgtatttccagtgataagttttacaaacataaataaaattattaatagttgccatccattttaaactttacctttgagatgaatatagattcggattgtttgtggaaagcttaatataatagcagctaatatttatagagtctttttttgtgcttttaatgtatttaatcttaacaacaacccaaggagataactgtaattaattccatgtaacctaagaggaaatttaggtgcagagtttgagcaacttgcctaaagtcacacaataaatgacagagtcaggatttgaatttgagtcccctggctcctaagtgcccaatcttaattgttgtgctatatattcatcatttaatttcacagttgtagccgttatctaagaggtagcctttttttttttttcacataacaggtaaaaacaactaaaggaactagggagagtcaggcattaggaagttaagtgtggagttgatttttttaagctggggcagtggtgagacagaacatacagaggatcatcttggcttctatactgattattcaatctgtctttgatcttttggtgggagagattcttagtatccctgtgtttttcaccaccctttacaaagccattgagcaattttggaagaaggggaaaatttgtgtattctgtttgtcctggtttatttgctcaaatgggggtttctctacttctacaagagttgttttaatcttcactactttttgagggcttttactgtgcgatgtttcatgtgtatttctcagaacaatcctacggtatttagtatttacttagcaagtagttgagggattttggctggccactctgacgtcatttgaactaggcacacattcaactactctgtcctcttttgtcgaagatagtgagagtggagggcctggagtagatacaagttgggaaagtgacatccttcaataacaagcttgtaggctgtaaaccacaaaggatggcttattgaaatggaatatcactattagtttctcattatcctgtcagaaaagagaaattgcaactaaagcataataaagggggttttcgaagccacaaaccgcatctttgctcttcagatgtatcttacttgttgaatagtaagtgaatgagatttatgaaatgttcatagtaagatgactgagaacaattgtttctccattttttagaatcagttgcttctttttcttttttcctctctttttctttcttcttttcctcttctcttctcttctttttcttttttgacagagtctcactctgttgcccaggctggagtgcagtggtggaattatagctcactgcagcctctacctcctggcttatgtggtcttcccacctccgcctcctgagtagctgggactacaggtacccaccaccatgaccagctacgcttttttttgtttgtttgtttccctattaacagatggtctgtatgctgtcttctgaaagtaaatactcatggcctactctgaaggaattaagattattctttgaataattgacagcgactggtgctaaaatatattttacatttatggcccagtatatataagttctgtatattcaaaggaaatcaaaacaagcttcataaaacaattcttatctttatatgtgaatggtattgcattttctataccattctattcttttaaaacatgttggtctgacttattttaggtggaaaagatgtactacatgataattaaattccagaatttatttgtaatacaatattgaagcaacctggtcagatataatttaaactctttgctcataaagctcacactgaagaaagggtttactctttggatttgtttataagacttcttaagtcttgctgagttgccaatatctattccttgtagtaattgctaagattggaaacatttgctttttcaaatttttgactgcataataaacagtggggaataattaagactcaagaagatactgagaaaagggctaaattttagcaggcatactaatatatttgggtctatagtctcattttttttccaggtaaaagcatttatatggaaagtactacatttgtaaaaggcttttttttattctttgataacttctaatgtgtatctcttgagttttgcatatgttgtgagaacttggataatgataataatcaatttttacaaacttctgtttgaaatttagtttgatatggtcaacttaatttttactcacttgaaaacttccagtaaaatatacatgaaaaccaaaaacacagggcagccttttggggtgtgtgttctaaattgtggcttatttctggggctttttatattgtttcaatatactctttcaccttgctaataactttatagataattatccttgtttattgtctgtttctacctacatctgcgcctcttgacttcagtggcaaaataatatcacaacagaaggtggtttgatattttgtttctaggtgtctacattttacatggtaggccacacaagatagcatcattctcataaaatcatccattttcttggttttagctttctgattaacagtttaactatgaaagctggaatgacttaaactcaggggttttaatccagctttgccagccatgtccttaagatcccctgcattttaaccccaccatccgcaaactagattaactatcactgttaccgtcttagagcattgatatgggataaatcctccaaagggcttttgagggaaatgttttatatgtaataatgtgggatgaggaatatgaggaattacactcattttagtcttgttactataaagttatcaaacagaatatgacaagttacactcaatgccaaccatacctataaatactttttttcccattagtacacataatatattctcattgtagaatattagaaaacaattaggaatggaagacaagaacatttctaattacaatgcccagctataagcactgttaatattttggtatgtattcttccagtatggttttgtttagctacatgcatccacatcatgaacatactttcatatctttaattagaacttttgagtgtttgcaaagtgttacactaatgagcatttcagtttaactagttccttattgtttgactctcgggatggttgcacacttgtgttctgaacatacttgtaactgagtcttgacatacattctaaatcatttcttaggatgatatcaagtacagtgtaaagagtggtgaaaaataacaaaatgggcactaggagaattagatgtaagttttaactttgcctttaattgttgctgaaacttttaaatcactttcttcgctgggcttcatttcccttcctagtaacagaggtaaaatggagtaacccctgtagaggatttaattctgactgcaaaccatttgagatattttatggataaggaaactaggactgaaaaggactctagtgtctctttctctatgtttgaaggttttatcgccccagtcccccaccccttgcttgcttttttttttgtgatagtgcagaaggtcctgagtgccttgtggttctttagagtcatggtcataatcatccataatcattgattattgattaatggtgtctgaagctgattctattttgacttaaggagacccttttatggacaaaatatcacttaataccttattaactttaactgtttccttcaaaatcaggagtcccagcaactgatgactagataaaccaaatgtagtatatattcatacaatgggatattatttggccacagaaaggaatgaagtgctgatgcatgctacaacacggtgaatctagcaaactacgctatgtcaaagaagccagtcacaaaagattacatattacatgattccatttatgtgaaatgtccataacaggcaaaactatatagagggaaagtagattagtggttgcctagggctagagaccctgtgaggattggagtggttgatagctgaagggttcaaggtttctcactgaagcgatgaaaatgttctaaaattggtggtgatggttgcataactctgtgaatatactaaaaactgtcgaattgtgtgcattacatgggtgaatcatatgctatagggataactcaataaagctgttgtccccccaaaacaaaaaataatccccaaataatcacactgcaaatgattctgaaaaccttttgtttcaagtttctagatgtttggattataactaaatggaaactggtcatattaaactccttatgtgttgttagtttgtttcctgaaaatcttagtttaaatcccaatgtatgaggatgactgaattctattttcgtttggagtttcctttggggacttttactaagatacttgctaattgcaacaatttatgatctctctttctcgtttctcagtgtttctgaagtgctttgtagaataatcggattttggtatcttcagtggcaggctcagtgagtttttttcttttcttttttttttcccccccaagacagagtctcgctctgtcgcccaggctggggtgcagtggtgtgatcttggctcactgcaacttccgcttcctgggttcaagtgattctcctgccccagcctcccaggtagctgggattacaggcgcctgccaacatgcctggctaatttttgtgtttttagtagagatggagtttcaccatgttggccagcctggtctcgaactcctgacctcaggtgatctgcccaccttggcctcccaaagttgctgggattacagatgtgagccactgtgcccgactgcagtaggctgagttttctacttggtgtctggcacctgctagacaatactctacatgaatattttttgctatagcagaccccaaataacttagagttaatttgatttttttgttgttggtggtggtgtttatattggaattcatggcactgagttttgttttatttgcctgagtgtattcttgagttgctcatgaggtagttgcctgagagcctcagatactcctctattgggacacttcttctcttagatatattaattacagacaagtgagttgagccagagaaagcagaagtagggttaagaattgagtgtcttggaaatccagactacatttggtcattttcaatgaaattttcacatcctttaggagtttcacatccgttaggaggtttgtgtgtttttttttttttttttttttttttttttttaccagatccttagatattaaggttaaaatttaatcaacaaattttgttttttatttacagagacctataggatacacatggagttattaaacctaaggggtgaatgaaaagaaaaatgttggcagttctatcttaagtctttattgcctgcctttgcatgttgtcatgatattagccagagaaccaggcttttaaacccaaacattagtaaaccgtaaaacatatcttgagacaatctagtgcaacaagagcaaatttggcagaatttctgaagcgattccatgaccagtatttccaatacattaatctatttagatatgctttgggtacttttcctggcaaaatggtaaattgtgcaactggcgattaactcagatcttggaattagcctgtgactttgatcttacataaataagtttcctcagtaaagtttttgtttagtatctgaaatccagcttttttcaagagagcttttagctggactatcttctgtattgatactgagaattcagaattctctctcatgagtgaaatttgttaataagttcttgagagattgagaggtcctgtccttctgtctagaacacccctcctgcaaaccctaaataatgccttagttaagctgaagattcggaaaattgagatataacatgaagtaaaagtatttttgaagtcttttcaatccacctatgtattgcacacctgtgtgcccagcacataatatatgattatccatttagtgacaatgtattgggtgaccatggtgtgctgggtactgtattagagtataaagagatgaaaagacaatgtctttatgtagttaatgctataataggaatatgtattaaatgggagcctagaggtgatacatgctctttggaggcagagattgacgaggaattagaaaaggaacttaaggagagttgacttgaattggagagtggaagatgaatgtaatggcttggaattgaggagaggtggggagcagttttgggaggaagtcattctagggaaaggcacggtggtatggtgtgttttgaaagactgcatatagttgctatggctagaagaacatagtctctgtggatatggcaagagaagttgtggtcaaacttatgttttagaaatgttatttaggagtaatgctgggatggcttagagtggacaaagacagcccaatcaaaagtctcctgccatgaccgggcgtggtggctcatgtctgtaatcctagcacttttggaggctgaggtgggaggatcacctgaggtcaggagttcgacaccagcttggccaacatggtgaaaccccatctctacaacaaatacaaaaaattagctgggtgtggtggtggacgcctataatcccagctattagggaggctgaggcaggagaatcgcttgaacccgggaggcggaggttgcagtgagccgagatcacgccactgcactccagcctgggcgacagagcaaaactctgtctcaaaacaacaacaaagtctcctgccataatcagacagtcagcagctatgagaatagataagataggtgtctggaagaatgaagaaagggagaccgagaattggtgcctcaaaagaaaggacaggacttggattcaaattgatccttgtttgcatcagggactcctgagattcttatgaaaaccatagccaagtgcatatacgtatacccatgtaaaaattaacatgtagtagcagaaacccattcacaggctttcagaagtcatggatcccaggtttagagcccttgatctgtagaatgatggagagaaaagagtcagtaacctccatgtttactagagcccagaaatttggaagattactggtgcagccgacagattgggccagttgggtcatagcaggcaagatgaatacaattttggatgtattgagatttccccataagaatgagaacagtgaattgaacaatgagaacacgtggacacaggaaggggaacatcacacaccggggactgttgtggggtggggggaggggggagggatagcatcaggagatatacctaatgctaaatgacgagttaatgggtgcagcacagcaacatggcacatgtatacatatgtaacaaacctgcacgttgtgcacatgaaccctaaaacttaaagtataataataataaaaaaataaataaaatttaaaatgtttgccaacaacaacaacaaaaagaatgagaacagtgcatttgcctctgctgaagtgcttattgaacacctgtgctaaagagctcctgatgctggattaattataataacatacacttgaccagatgcagggtctagataagcaaaaataaatattaatcctactagagctgtagcttgaaatgtagtgtaccctggtttaaaatgctgtaaatggccaggcacagtggctcacgtctgaaatccccgtactttgggaggccgaggtgggtggatggcttgagcccaggagtacaagaccagcctgggcaacacggtgaaaccccatctctagaacaaatacaaaaattagccaggcttggtggtgtgtacctgtagtctcagctactcagggtagggggctgaagtggaggattgcttgagcctcggaggttgaggccttcatctgaaggatggaggtgagccttgattgcaccactgtattccagccagggcagcagagtgagaccctgtctcaataaataaattaaattaaatgctctgagcaatggttttattttgcttctttagtttaggaggctaccctgttattgtgtgtgtgtgtgtttgttttttttttttttcccagatggggtcttgctctgtctcacaggctggaatgcagtagtgtgatcccggctcactgcaacctccgcctcctgggttcaagcaattctcctaccttagcctctcgagtagctgggattacaggtgcctgctgccactcccagctaatttttgtatttgtggtaaagatggggtttcaccatgttgaccaggctggtcttgaactcctgacctcaagtgatccgcccaccttagccttccaaagtgcacatttagtaggcattgacagtgttaatctttgagtggaaatagctggagaatactccgaataaggctgaaaaaatgtgggattatcacatttaagagggccctgtttctatatacttaatgcttttgcactgaaatgtttgatattttagttgacagcgttcttaagcaataattttggcatcagagaagtcacttagataatttcttggatccccatgagcactggtaatttgtagaacaggttgaaaggggattgtgaaaatagtcagtcttaggtgtgtgaggtcatcttgtctcgcttcctctccaccaggttaaaaccacacctcagggctccaggaagctgactgagcacgtagtccaaagaaattttgcattctggtatttttcagtgttttcttgtgattttcatctttaagctaatttgttgagaagggcttataggatttgctctctttgggcaagcttcctcatcagtatcaatggctgtagtcatgcagtcctgttgtgaccatgttcaactgaattgacaactaatatgtatcacgccacaccactctgcggttttgccctttgtaaatgttggcttcatctgggaaattgttagaaatgaagattcttggttcgtgttcttgacctactgagccagtctacgtattaacaagatctcacacgtgactcacgtgtgcattaaaatctgagacttactggactagctcaggaacatggcctctcagagcccttttgctgaagttcaaggctttttctgtttattttctcctcagaagtgatgagaaacatctggtcaccatctttcatgcagtatacattttcatggaattaaagataatgatttaggtgcctctaagctgtctcttcttcaagcttaataactgaagtttgtgtgatctctttcttcatagagaagatgatcttttagcctttcatcctttattgcctttggtctctgtttcctagataagtttttaaaaaacgtcatttctgaaatgggcagaatactcttatcagagtgtggttgctactaaataagcaaaataacttaacccatgtattttttaagatctaggggcatttggctaaattttttgttttattttaaaagtttttttttttaagcagtaaaaatagcaactaattcttccttgagggaacttcaaacccaaaaagtacctcctctcttttctgaaggatggaataagttgaccaatggtctttggcattcttttgggttggtacttcaggctaattttacaatagaggaaggaatgatggaaagagggaaagaagtaaagagagaaaggaaagaaggagggagagaaagggggagcgaagggaaccagattaataattcaaagcagaagagactattaaaagtcactcaggtgggaaatgagaggtttatttttggtgactgctttacaaatgttttggttttgggatgtgaaggagaattctttgaactattaacatttttttcctcctgacttttgaaggtcagacttttatccaccttttgcttataggaatagttcaattttgcatggaattacatttgtggttttttgtgtgtgtgttttttaaggcatcagggttatatctgaatcatcatcttttgcatgtttttagtctggacatcttttaattcagtgcaagttgtagctctgaatgagatgctccttagttttctgcaataaagcatccacctgagaaagggagagtagtctgagtgtaggatcttctaaagtgattcttaaaatcatacttcccactttgttttaaaggaagaatgtttgtgcagtgtcaaaacattaaaagaactggagaaaccttggcatattcagcattcgctgtatcatcttgtcacagcaggaggagacaatagtggctaattcactaattgcttcctatcacatttacacaaggttgtagggtcagcattaccttgctgggttgtaatttaatgagcccaaaaggtttctttatcttaaatccagattagtcacatggctgattggcaaataaaacttgggcaagtgcttgctacgcagttaaattacagtctattgaccttaagtatggctttcattaaacagtaatgtacttgcttgatgccctgcctttggtatttcattttattgagtttgcctgaatccctgctaatcctcaaaatttgtgggtctggtaaggctgttggctgaatgaagagggtagaggtttattggtgcacttactgcgtgccgattgtctaggccactgacacatgcaacttagcctctgtggctggacatgtacatagttaacagtaaagcatttctctctttccctagacaggaccatggggtctgagttagtgtgaaagaatgcaaggatgtggaaatttgaacctcagggttgttcttactgctgctgtgtttcccggaaaacagccattgacttttcttctttctttttaacatggggaaggcatttatagcataatggagtattgtttgattatttatatgcatttccttgggtctttttgcttttagagttttgttgatttgttctttgctgtgtattgtggggaatagggtatgtgtatttgctgtgtattgtgtggggaatagggtatgaagcctatagggaagaagggtggatggagaggcactaaaagtacagggatttgacttattttaacaagaaaaaattctgatgactaaagataatttgtgaacatgtagttatggcttcataccttttgtcttagttcaggctggtataacaaattagtgtagatgaagtggcttgaacaacaaactttgatttctcacggttctggaggttgtaagttcaagatcagggtgccacccagtatggttgggctctggtgagtggcttattctgggttgtgtgctgctgatttcttgtatcctcacatggcagaaagagaactaggaagctccccggggtctctttttataagggcactaatcccattcatgaagactctgctgtcatgacctgtttcctcccaaaggccccaccttttaataccatcaagttgggggctaggatttcaacacatgaatttgacagtgggacacaaaaattcagtccatgcatcccttcaaataatatgagcttttattaccattaggaggactacattgattgagttgattggaagtagattttcagaaatgacttccagttatctattgatactataaacaaggtggtatttcattaatgataggacctgtgttggtcccttaggaatgatgcattctttgcagagaagagttgatcaaggtgagtcctgttacttgaacctttgtgaaggacaaagtaaagaatcatcccaaaacaggaaatgccacacttttatttcctgaggattgagttcatcaggaaagatataatagttatctcttgttgtgtaaacaataacaaactactgcaaagctagaggcttaaaactatggtaaatatttattatctcccagtgtctatgggtcaggaatttgggtggttctgccttagggcctctcacgaggtcgcaatcatatgatggcttgaccgggccacggggatttacttcagaggtgtctcgctgatgtagttggtaagttgctgttgcctaatgatgtgaagcctaagttggtaagttgctgttgcctaatgatataaagcctaagtgccactccataaaggagtttctacagactgcatgttaacacagcatggcatctgggagcaatctgagagacagcaagatggaaactgcagtggattttattccctagcttaggaagttctttaccatcactttccaatattctgctgataacacaagtcagccctatttatcatggggggactggacaagggcattaatatcaattggctaggatcattggaggctggttgtaccacaaaggacacttgattggctttttatctcagttgctttctctaatgttgtcagtgctatggtttgaatatttgttccttccaaaactcatgtcgaaatgtaatccctgctgggcgcggtggctcatgcctgtaatcccagtactttgggaggctgaggcgggcggatcatgagttcaggagattgaaaccatcctggccaacatggtgaatccctatctctactaaaagtacaaaaattagctgggcgtggtgccatgtgcctgtagtcccagctacttgggaagctgaggcaggagaatcgcttgaacctgggaggcagaggttgcagtgagcagagattgcgccactgcactccagcctgggtgacagagtgagactctgtctcaaaaaaaaaaaaaaaaaaaaagaaagaaatgtaatccctaatgtggtggtattgataagtggggtcctgagggttttgccttcatgcatgaattgatccattcatgaattaatgggttatcatgggagtgagactggtggttttctaggaagaggaagagagacatgagctagcagacttagccccctcaccttgcgatggcctgtaccacctcaggactctgtagaaagtccccaccagcaagaaagccctcaccagatgtgggccctccaccttgaacttcccagcctccataactacaagaaataaattccctttctttataaattacccagtttcagatatcttattatgagcaacagaaaataaatggagccaggtgacactacagcttctttaagctcacatgtcgggtgtagtatatggaagataagagtcctcaatttggtggggagaaatcatacatctcagggtaaggatttttccgttgctaataaaggtattttagtcgatataaatacaagtactatttggcatgcattattagcctgttacctttgttgagcactaagagtactctgtaggtaggtaaattatagttagaggtccatctaaggagagtctaatttagcatttgtgtcagatttatgtttcctaatgtgttgattatatggaaggttcttttggaaatttggttagttgcctgccttcagatagctacataaattgcacagcatgcaccataggtgcattctttatatggttcatgggaggatttggtttatttttagagtttgacatagggttctttgggagaaagtttgttactgcatctgggaaaagatcctcttggtgatgcatcttcatctcacccatttattcttgggatgctttctgtgtgttaatggagggttttcactgcattgtgctcatgaagggccttgaactccccctttgtgctttaaccttggcagggtctgtatggctgaccttgcacttctgagaacttctctgcagttccctttgggcggcctgaacattggctgtttaataccaattaaaagcaagggctgttcctctcagtggattgctattaattacagcccgtgttccagtaatctgagacagagcagcttcctctggtttcattgaaggctactttagctctctgttttggttggctgataaaaatctgagaggcacatactgatttggaataggaagagtattctgaccccaagaagaggtatctgggagttggaagatgagtgctctgttcttatcgtgtctttgggttaggtggggcatataagggaacatggtgaaatcaaacagtcctggacccatgtcagagatcagggttctagttccagccttaacactaacaggttgtgtaacttggaactaatcatttcatctcttcctataccagtttactgggtttaaacaaagttatcttgattgtcccttctgtgtctaaaattttgctaaaaattggttactgttcttataaatgatatgaaatattatgagactattcaaggttaattctttaacttgagattttaagaatcagttttttaaaataagtttttttgggcatttaatggtatgggtgaagtctggtggtccctgatgattggtttagttactgggatattttctccatgaacagttggggggagttttagtttgtgccagaatgtagatagaagggtatatttgggtttggtgtttctgaagcactttagttcaatgagattttgaaggaaatccctggatagagattatagtcatcccttgggttctgggggattggtctcaggacctcctgtggataccaaaatccatgggtgttcaagtctctgatataaagtggcatattgtttgcatctgacccatgcacatccgcccttatactttaaatcacctatagattatctataattcctaacgcaatgtctacacatcacttcattcttgtggattcaacgtagtacttggcatgtggcaaattcaagttttggtttctggaaccttgtggaaattttttttttttcctgaatattttgtatccctgctttgttgaatccgcagatgtggaacccatggatacagaaggctgactgtatttttttttttaaactctcagaaatctgggatgtaagagttcaactcgattcatgaagcataatttattactattttttttttgcactagaaatcagaacacattaatggttgaaggttttttggctttgagaagaggctaggaggtgttctttgcatacaaaacagtagattttcctgtatgttgtgattggttatatgggcagaggaaaagaatatttgaaactatggttgatctgtgtaattctaggcatatggaggctttgcctttaggtacttttcgccttcagactgctcttaagggtaggaaacatctcagttatgtatgtaataatcattaaatgaatgttcccaaatgaataaagagacttaataacaggtgtagcgttaaaagagaggctgcaaaggggaatccttcaccctaaattccaaattccaaagtggaagaataaccactctggggtgggagtgttattttctcaagtgctaaaagggagatatgaactatcctgcttggcctgtgggagagggtcatggttattagggttgggtaatatttttgttacaaatgtgtagaagaatgtcattaattgtggcctttagcacgcagattttcttgatcagataataccttgacaactccagacaagtgactgctaatcttgtgtcagttgtaaatatgtgtttggaaggtgatattgaaccagtgggttatttcagtcaagatgtttgaaaaagaggtatacatcaaatgaaaatgacgcggattatggaaaagtcttaattttaatggcttaaaaaaattctgcattaaacccgaaaaactagagacatagaccagctgggaggtactatgagaaactgctttacaaatgattttctgtggaaccctgtcaccagcatttagtgaaacatgctttccatttgaatatgcatttagatgaggccaactggctgctagatcatcgtctaatgggcctgtgatcccacatgaagattattttccctttggtcctagaaccactctccatcctgctcacccttatagactatatgagagggtccctaggtctcactttcaggtgggctcagccagtggaaatcagagaggtgtgagttcgtggtatgtattttgtccctgctccctgctaggctgtcctgatgcatttagactgaggtggtcactgcttttcactggtgctattgaactggaactatagtttcccattggtgagatgttgttactacagtttttcacatacatgtatatttcacatacatatattttaattttttacatttattgtttctccagtgagttaaagccttagaggattgagtttacttttagcacctaagaatactactaccttttcatggaggaagatcattgaaactgtaagagtttgcagttacagaagcagtatcctctctggagcactgaacaggtgttgggggccagaggattcaagccctgtccaccattccctgctgagcaccttctctaccagcagtagctcttcagcctctgaaggcatggcggaggcctggagtagggccctgccaaccttgaatgctcatgcctggtaggttatgaggattaagttacataagattgtatgtgcttaaaataggagttggcatagaacaagtactccttgattttgatctggtctaattcattcatatttaggatgaaaaaatggtagcaatgttaagtttaattcagatgacaagacttactaaaaggtctttctgatacctcatctatacatatagtattctactctgtgtagatcatctaaaatttctataagttggagatgatcttggcttttctgttttaagattacaatgaaagacagtgaaatctgcagctgaatttagggaagactccttgaaaacatcatcagttggctttctcatttggaatacaaatggacagttgtatcctcctgccattgctttgttatgattatctaggagttttcttatttttttaaaatgtgactttatagacatttcaagtactataacatttagccattgaagctctctctctctctctctctctctctctatatatatatatatatataattattattattttttgagacagtcttgcttagtcctccaggctgtagtgcagtgatgtgatctctgctcaccccaacctctgcttcccaggttcaagcgattctcgtgcctcagcctcccaagtagctgggattacaggcatgtaccaccacgcccagctaagttttgtatttttagtagagacggggtttcaccatgttggccaggctggccttgaactcctggcctcaagtgatccaaccccccttgacctcccaaagtgctgggattacaggcatgagccactgtgtccagccactataattgatttttagtaaattctgtggaatatacagcattttatttttcgattcatcagttggtggacgtttaaattgcttctactttctggctattatgaataatgctgctgtgagcattcttatacacgtttttgtgtggacatatgttttcttaggagctactcttactttgttgctagctgaggcttctaggactgggatccttcgaacactgcatgtacctataatactcttggaggagaggaggattcctctgaagtcagaaatatcctccctggagaattctgcaaggagttggatggactcattggggccgaggaaggagctttgagccagggatgtctcaggaatgtgagagttgaagcacagctgtgcagtgtggccttgggcaacttgccagctgccttacctgtagggaaagggtgatgttactactgaaaattgtgacctcctccagacaccagtggtgaggattaattagtaaatgttggctgtgctaagcttttcctttggctcttctttattctcagaggcagccctgctttttagggctgaaggtagtaagatctgtaagaaaaagccagagaaacccaccttgtcattgctttcttgggaattaagggttatcttgtgtttggttaggacaccagttagtttccagcattctcagtggaggtaatcagatcttggaaactttgagggcatgtgatcaagcaaacaacaaaactctgaggattagaggactgatagagaccctgtgaagggttcacctggaaggaggcagtatggtggtgtggaaacaacctgctttgtggagtcacatagatctgggatggaagcctggttttaccaatctctctcgagttactgaataggaatagtgatgaccacttgtcagaattgtggcagggatgaaatatgacagcaattgtaaagaacctgtcacagtggctgacatactgtagattatttgtgattattcatttcctttttcatctggttcattgctgaacttctaggcaaactgccatcttacagagagactgggatggagggcaagcctcccttgtaactgttggtatctatttgattttggacaagacttccctttccttcactagatcttgaaagttttttagtgtcaaaattctcagataagcatctcatcttatttttagacatgtaggagttagtctatcctcttttaaagagttcttgttgaaagttaatgcatttattttttatcttctatagtttcctgttcaatatggtagcaaccagtcatatgtagctattgaaacgtaaattaaatgtaaataaaaaattcagtttctcagttgctctagctacattacaggtacacaagagctacatgtggctagtagctactccattggacagtatataggatagaacatgtatgtcatcacagaaagttccattgtacagtactgctctatggaataagactctaaaaagtgggagtttcagtagaagcttattcttgcatttgtatgaatctgtctgtggctagaactctggcatcccattacttgggattgctaaaataatcatacttgcagtaatgacccactgaggcccttgtttctcaagtagtcttaaagttttgaacttaaagataaaagatgggctgggtgtggtggcttacgcctgtaatcccagcactttgggaggctgaggtaggcaaatcgcttgaacccggaagttcaagaccaccctgcctctactaagaacacaaaaattagccaggcatggtggcacatgcctgtagtcccagctactagggaggctgaggtggtaggattgcttgaacccgggaggtggaggttgcagtgagccaagattgcaccactgcactccagcctaggtgacagagtgagaccctgtcttgaaaaaaaaaaaaaaaaaaagttaaaatataaattcagcctgtgtttactctgcaaacaatctcaccagctctccagacctctaccaagtcatagggactgccttgctttgaggtgaaagtttatatgcaagtatctttttaagtaggaccatttagaaagaatatgtttgaattgagtttgctctaagtaatgtttaacactttaatatccttttctatttatgggaatataagctaacagcatttatactttattttcagaataccagtggttttcttagctctggaagaactatatctttagatcccaatgtagacttaaattaaataaatccgtttggctggcttcatctggatacaaatgactacatatttgtaataggtacttgatttcatgtttaacttacttttctgtttttcctctgtattttgttttcagagcattgagttagcaatcagaagaactaatgtttattctcttccaaatccccttcttgctttcttacttattaagcattgtctgtgtgatttgcttaggatacaaaaaatgatcacaatgtggttttggcttaggaggggctcatgtgaagtggtccatgacctgtctgccttattgctttgttgatgggtttgatagaaggttaagtgtgaaatgctgtgtagacagctcattgttacacaacatctgtattattagcatcctttttaatgagatagatggaggtgtgggctatgaatgagattcttcatggcgtgagttttctggcgggattttttaagagtgagaagaggtgtgccttgaagcaggtaagtaggagaacctactccagatattgagagggatggctagagaaggactgaatagaccagctgcaaaaaaaaaaaaaaaaaaaaaaaaaagccagggcagaggaaggaggtgaatgccaggtatctttctgatgactgtactgtgtattttctaatattctttgaaaactttgagatcagcagagatgctgagccctgctgatgaggaagggagatttgtttagagaccgctaatgatactttaaaggtgcgtgcagtgtgtctgtgtactaggcaggtgccatttaagtcagaagccactttcctgctttaggacaggtgctgggatgtggaagctagggatgcaaagttacagctctgtgttggtttattggccacctcatcatgagtgcttctacttcgttagtgacctctgatatgactgctggatagtcttcttgcagtaacttcctttaaaactacggtggtttgtggtgaataaaatttattttcaaattgtattattgcttttaactggtctcagagatctgggctgccttgatataggccagtgtttaactaagcaaagtgttatgtcagaatgtggttactattccattatttcttcatccttcaattttgctttaatttgatcttaaatttgcaagtacctaatgtttttaagagtgttatatatatcatttttccctaattttaaaacctaaatactttaacaagctgctcaacatgaagaagggaatggtttgaatcagtttatgaaagaatactctgttcccaggttgggtgggtgccctgtcaatagctttattatgtatggcaaacacaatgctaagaaaacttattagaaactgaagtcttaaatgcttgggagattataatgtgttccgacttcaaaattttaagttaacttccgctaccagtttctatgagactgatttctgtagtctgctttctgtagtcatagaaaatagtagtgaaagctatagaaagctgtagaaatggagaggtgggtgagaatttattaaggtgccttcaaacatataaactagaaatagattcagttatatcaaagataggcctagatgtggacggaatagtgaatagtttctggggctactctttcaacatggatctatctggttaattgatactagtcattctctactgctatttttatagcattcatcacattttaatttttgtggccatctcatcctgggctttgagcagccaagaataaggttagttcatctttgtatctcttgcatctagcatggtacctggcacatagaaagcattcaataaatactgtactgattgaatgaaacattttttacaaatgtgtttgaaccaaaggcagcctattgttaaccttggtgagccttggaaagctttttgcttgtggtgacgtagcaactgaaatattttgtaaaaagtgaaaataccttcaaatgatttatctctttctgatctttattaagacagcagtgttgtatccacacattcctaactgtgtgtagtcagttcttacaagttcttgccatgcttgtgtccttaaaatgtttcacaattttggcactgagaagccagagcgaagtgaaggagttgctcattgttctccatacactctgggttctcccacctctgcaccttggctcaggttttcccctttagctagaatgccctttttccttggctttggctgtctcctaatggattactcgctgtacctacccttctaggctgagctcatagctagcatatgtaatctaacatttgaatcagttgagaaaactcttattttcctgctctatacacccagtatagttggtttgcaggtgtctgtggagtttgttttatacagtgcctgttgggctagagctgcattatagctagtgtctgtaagaccgttctagtttaagagcatgcagggtggcgacagtgagatgagactggctgtatcagtttatggctgttcagtttatggcaggtgacttaaactgagccttcattttctcataagcaaaatgggaacttagtataactaagtaggaaaatgtatataatgcctaggaatggcttttgctaggtgcctaataagtagagtttccttttcttctctttatttcaaatgatgtaaaagaagccttgttttgaaaccaagagttgttaatctgaccaaatttcatgaaaggatattgatcacaacatatttgttatcagagtttggtaacacctgactaattttttgtattgctttgggatttatttaagcatgtgagactggtattacctaaggttttagttgacagaagatggatagcctgagaggtcgaaattatgagagcaaaagacttttgaaaatttctgccatggcatatttcatacgtttcagcttggtgtccagggtttccctgaacagacgagtttgtgacatacgagctcataaatatacttgcctgtgccctcttccagaagggaaagccagatctccagggatgctaactgttggggagacaatgagaggagcttcttgtctgaatatctttgttcacagcagagatcatatttgaagttcttctcttcatcaaaaagagcagaatggaaaatggtttaatattcctgtcgttagggtttccgctctgtgtggggtcatgagagtcacagtctttattctgaattctgaaatgatggtttgttttacttttaaaaatgcatctcacagggaaatagagaattgttcctgtgaacttcctgcctgctgtactaaacgcagttgctgtggcagtttttaaaaagaaattaaaatgcagtaatgctttaaatgtactgctttaagaaactcgataactcttgattagttagcataacaaacagcaaagcagaacttttttttttttctttttgagataggatctcctccagcccaggctggagtacagtagcacaatcacggctcactgcagccaggctcaatagatctgcccacctcagcctcctgaggaggctggaactacaagcaggcatcatcacacccagctaatttttgtattttttgtagagatggggtttcaccatgttgcccaggcaggtcttgaacttctgggttcaagtgatttgcccgcctcagcctcccaaagtgctgggattacaggagtgagccaccatgcctggcctagaatctttacataccggttttaaccatgttgtttcactttttgaagcacttaataggaggtaaatatacttttgaaagttacatacttaatagaaacacacattaatggtacccaaagaaccaactcactcgtagattgtgctccatttttgtgcggaagtttttgtgccagccaattacatttgcttctgtggtagatttctcttcattgggtcaaaggagaggcgtcattaaggaaagcgcatgtgtctttgtttcctctgggtgttctgatgtgagagagcctggcttcttcagtagaagattctgggaggtttttgataatcaagtgtgggaggtcttttctaattttcagtgcttcctggtgagaaaagcagatctcaagaagggctgagagagggtccacttgcctccacaaagatcctgatgctaatagaggctaaagagtcacttttggcttcaacttttaactgcattcttagggctcttaatgtattatggacttgaaatttgcaatgagagtagatctcaagtggtctcaccatacacacccacaccaagaaaggaaacgatgtgaggtgatagataatgctaattagcttgattgtggtaatcatttcacaatataaacttatataaaaaaatcacatacacctttattatatatataattcttgtcagtcatacctcaataaagctggggaaaaaatagaagtgtgtccataatattcaataaataatacagtcatgagccacataacatttccatcaaaaacggacaacaaactggtctcacaagattataatagagctgagaattcctatcatccagtgacattgtagctgccttaacatagggcaatgcattacccacgtgtttgtagtgatgttggtgtaaacaaacctactgtgctgcaaatggagaacacatacaattatgttcagtatataatacttgataatgatcataaacgactaagttactggcttaaaaaaataggagtgtggtgagggagagaccaacaaatagggcagagagagaggtagttttaatttctgggagagatgcggatattaaatttacctcccttggaaacactggaaggaggataaagcaagagggctctgggaatctagtggaaactttttaggtgtggacacttccgttaatcctttttttttttttttttttttgtagtttagggggcaatagtgtattaggctctaactttgggttttgtgatttccttttataagataaatttagttttcttttttggagtttaattgtttattgtaatgctaattgtcttcatgtagcatgttgtaagcttaaaatgttccgtaagagtaacctggcgtggtggtgcatgtctgtagtcctagctactagggaggctgagatgggatgatagtttgaacacaggagttcgagaccagcctgggcaacataataagaccctgtttcaaatcaaaaaaccaaaaaatatttcataaaaggtagctgctattaataatggcataattataataatatcttactgttattatatatccagaatggttatagcaaacttggtgctctttgaaaattaccacagcagctaaccctggaaaccaaagaaagccattgaggaaaccctagccatccccaaacttagaggaaataagttaaggcatttatttagtcttcaagggttttatttatggcaaagaaatgaggagaagtcatcatcagtttgatgattagcatctgttttatttagagaattttgacatcataaactaggaatttgtaaaactgtatgtgcatatttttctacatctggggagctaccatatgttatacagatctcatcccttacatttctagagttgtactgtaggaactatgtctagtaaaaatctcactcttggcttatatgcatttggaattaccctttcatataataaagaaatagggtattgatttctatttttgtgaatgcttactttgtgtatatttatctttttaagttttcgtagcagctctgcaaagtaggcattttatctttattttccaggtgaggaaactgattctgaggagtaaaataatttgctcaaagttttgtgatagtggcagtactcaggttggaaacaaggattggctgactccaaagtccattttctgtttgttacttaagttgtacttacacattttcctaaatttatttttctcatgacttgtcctcactccagagtctggattaccagcccctgtggtctagcagaagtttgggatgttgaggtagggcctgggcattggggtgtagacatcgatattgctggccaggataggggctaggccatggaatgactgtgggtagaactcagctggtggggagatatggtccatttgatggctgacattagtgagagggcaggagagtactcttgatcagtgattggtttcccaggacagaagcaaagccttccctcaggcttcctgagtgaaagagcatccttcaaacatcgtgcttgaaaggtggactcttctcctcggttcagtggaggcagcctgcctgggtcccttgagtgcgccttcatcctggggcatcttgggatttaggaagcttgtatctgaattttggaatgcaagggcttctggtgggggccattatattttcagctaagattggccttccctggtccagagcctgcacacgtttctaaaatctttttcaaactctctgctgcttcattaaagtaagaaaaaatagctacactctagatttggtttcttgtttcttcaatgacactttgtctcctcatcctaacacagtaatcaactaacctagtaaactaacccatgttagtgtagctaatatccataaatgtattagaggaagaattcttttttagcaagaaactccgaggccatgctccctatctttgtctaactccttggtgactttagtaatgagaattttaatctagaggctccagggagacaccctccccacaaagtgtgggattgctcctgtattctgttaatgcctatttgttaaaagagttaacagtgacccttgaaccatgaagcaactctttttggtgctaaaagaacacaagtgcccaagaatgcagcagcatcgaaactggggatgaagtgatttgttcttgacatcagttggcaggtacattctcttgcagagagtaaagatgaaatagaatcccattcatagaaggcagtttgtagggagggaggctggggatgggaaaatgagctcaggctcagaggccttttacgtcttagtgttctcacaaatatgcttccaataaaaaccatttaaaaggcaaaatataaaattcttccatttaggaggaccttgctgagatctatggtggtggtttaaactgtgccgtgattagaaccatgccctatgaatgtgtaatatgttgtcgaccagatggtcatataatgctcactgtcctggtgagtttgaattagggagctggggaaatcttggctgagaaaaggtaagataaggcaaaagtatatctgcttgaggggcaaagttgcattcaactgatttggtctctgcagaagtttgccatagaaatctgtcagtgtgtactgctttctactattaattggggttttagtcacatgctttgtggtttgttcatgaagtttttatttaaatgacttatgagaactatcaaaatgtttgctctgaaggcttaaattgtgttcttatgccatggattttttttcagatgatcaacttacccatgtgaaaatgcttgagcaggttggctgccaaattgtaatgaaaggctgtcagcaatgccttgatttatctttctttcacctctcctggatatgctgtctgcttcctaagtctaagagggatatactcagtcctgcagacaacatctgtgcttctgcatcaggttccctgcctttcttgggagctttaaacataagagtatcaggaaaggttccatagttggtgacaatagaagataggttagttttgggcaaatgaggaaatgaaatgagcttctctttctcctagcataccctgctgagatttattcccagcaccttcaagggggctattgtagaatgcaatccccagtgctctcagtgaaagggagaattacaaagtacagagtcttatcctttcactgtaatcccgggtgcacacttggattcttgatctgtaagtgggagtgtggtccagacctcattcaatgtaaagctcttatagagaccctgattttttaaagggaatttctgctgttgccacttgtcttgtcatcttctccctgagaatgttttaccatagcagttaataagttatgtgattttaaatacctcttcacttggaggagtcagtgcctgtggtaagtcctttgaccattcattaactcattcaaactctaggctttagctgacaactttttcattagcagctttctttgcttgttattttactttgattttcatgcttttcaccttatatgtgtctatctgttttccctctaggactttcatgaccctacattttcagcaattcattgtctgtctgatttgatgttattaccttgaggcctggagatttcttacacagaggtgtttttcattgacctggataaactcagaaacaagtcatcactgtcttttggcatcccgcctccccatttatgtgttattcaccatagtctaattaaatatgttaagtagcaatgccggaagaagtagattctgctttcaaaatggttttaatttatctcaacaaaggtagagaaaacctttgttgctttaggagtctaggagactcccctgggcaaagtttgctgttttttcttcccagattccccttgcccttcaccattcctccaagacgcttgaggaatgatgatttaaaagaaaaaggtcatgagggaggactggttcatagatatttcatgaaaaagtgtggcctgtcttgggattaaaccattcctgggaagtagaaatgagctcttcattgctttgtaggcaaccacagtatataaatactgtagaagatctgggttaaaaaccaaagcccaactgttatctatagtgtgctgttgccaagctcccagtaaagttttagtttaacagaccacattgtggctgataatgataattttgtgttatccctattggatgagtggctagcctgtttccacagtagacagatgcttttcttaatggcagacaccagcccagggccttgctttgtagtaggcctttgataaatgtttgttagatttaattgcctgctgacttgttgagtacggagtgtgattagattaaaactaatatgttgtaattaagaactatcagtcacaaaacaaatttaatttttttctataaatgtatgaaatataaaagttataaaataattatgacttatcaaggggaaagttgtgacttatcaagccctgcttatactgcattcagtagctgaggttcagttcatttccacatttgagtttgaactccatgtctggttgttttttaaatgtgtgtgttttttctttttttttggtgggaattggagttggggtctctctgtcatacgggctagagtgcagtagtgcaatgatagctgactgcagcctcaaacttttggactcaagccatcctcctgcctcagcctcctgagtagctaggtgtcatcacacctggctaattaaaaaaaaaattttttttttttttgtagaggtggtgtctcactatgttgcccaggctggtcttgatctcctgggctcacacaatcctcttgactcaacctaccgaagcactgggattacaggtgtgggccactgcgcttggctgcacgttttctttccacagttttttctgtcctttgttgaaaggcttcattgtcctgctgataattaggctaatataataagaattaggaagattcttctttatcacctgttcttagatgacaaagattcttagaaattcttgctctgtttattttgtacttccgggtaatgtagtttagatctgaagagacataattgaggttagctctcacagaggaggaaaatacttgtgtactaaggatcagtttaaatgactcaagaaaagcaatcaaagaagtgttatctttaccattgtattggtctgttctcacattgctaataaagacatacgttagactgggtatttataaaggaagaggtttaattgactcacagttcagcatggctggggaggcctcaggaaatttacaatcatggtggaaggggaagcaaacgcgtccttcttcacgtgtcggcagcaaggagaagtatgaacggaatgggagaaaagcccttacgaaaccatcagatctcatgagaactcactatcttgagaacagcatgagcctaactacccccgtgattcaattaccttccaccgagtccctcccatgacatgtggggattatgggaactacaattcaagatgacatttgggtggggacacagccaaaccatatcaaccatattctgcctaaattagaagcctatctctaatcacagcttaattattcaagtgcctaatgtcaccacagattcttcttttaattggtgattttctaatactattgcaggaccttctgattgatagtttgtgcacaagttttcaaaaagaagttagtgtctctttttaagagaaattcatcaactaaagtgacattagaaccagtgattaaaaattactgaggtcacatctgtggatgtctatgactgtctactttttgtttatagaactcatgactgtttaaatgaaagcagtcacctcagtcctcactaaaaacaatgattgttaaaaatataaaatttaaggtggctagcaggatgaggcaataaataccagataaatggagtcatgagtaaaagtattaatgtcaaggcttctttttggttgaaatctaaatgctgtttttcaatttggacttaacagggagggtgctgcaaatgaaaggagcattttttttttctataaagcctaacacagtgttagggtgtcttagtccatttgggctgctgtacagtaacagagtactataaattaggtagcttctaaagaacagaaacttatttctcatggttctggagactgagaagtccaagatcaaggcatcagcaaatttgaggggaggacctgcctcctggtttggagacagccatccttctgctgtatcttcatatagcagaaaggataagtaagctctctgggacctcttttttaggggcactaatcgcatttacgaggactccgccttcatgatctaatcacctcccaagagccccatctcctaaaaccattacatttaggggttaggtttcaacctatgaattttgaggagacacattcagtttatggcagtgggagatactttgtcttcagataattagatctttaactccgaattcttatgtaccttttagaaataaggactgatttagactagagttgttgggcccggcgtgacccgaagtagtggagagagcacaggactagagcgcagacctcaggacgtggatccgagccggcgcgatgggcggagagcaggaggaggagcggttcgatggcatgttgctggccatggctcagcagcacgagggcggcgtgcaggagcttgtgaacactttcttcagcttccttcgacgcaaaacagactttttcactgcaggagaagaggggatggcaaagaagcttatcatacagactttcagccacgacaatcagctggcacagaaggcccggtgggagaagagaacccgggagaaggtggagcgggtggccgggctggccaaggaagccaagtcagagacctcggggccccagataaaggcagacaggcagagaggctgcagctagagattgaccagaaaaaggatgcagagaatcatgaggcccagctcaagaacggcagccttgactccccaggaaagcaggagaagaaggaggaagatgaggaggacaaaggaaaactgaagcccaacctaggcaacggggcagacctgcccaattactgctggacccagagcctgtcggagctggacctggtggtccctttccgtgtaaacttccggctgaaagggaaggacatggtggtggacatccaggggcagcacctccgggtggggctcaaggggcagccagcaatcatcgatggggagctctacaacgaagtgaaggtaggggagagctcgtggctcattgaggatggcaaggtggtgactgtgcatcttgagaagatcaataagatggagtggtggagctgcttggtgtccagtgaccctaagatcaataccaagatgattaaccctgagaattccaagctgtcagacctggacaatgagactcgcagcatggtggaaaagatgatgtatgaccagagacagaagtccatggggctgccaatctcagacgaacagaagaaacaggagattctgaagaagttcatggatcagcatctggagatggatttttccaaggccaaattcaactagcccgtgctttttcctccctgaactcttggggctgagctacaaccatccaaccttctttcccactcttctctggcccttgtgagcctcagggcttggggtaggcatgggactggcctagacacacggatcccagggcatcaggagaaaggctggggcttggggtcttgtcttccccagttggcctactgttaggcattaaagcaatttgcccagcaaaaacagaaataagtactgatttatttcctcatttgtgatgccaaattgtaaagattaaggtaattgttctgttaaggtatgaaaataaatgacttataagagacagaggcagataggatattggcaaccttcacaccctagtttgaaaggtactggcctttcttggctgtgctgaggcatgaataaatactatagcaatagtaaccacacctttgttgtattttatttcttcaattaccatctgttgttgcagcttttagctaaagcagagcttcccgaacttccaacttgaatcatagcactgcgtcttggtgaattgattctagaggtggaagttagtgccttaaatttgatgcagtcacatatgccttttgggtgacttcactttgaatcctcaaaggatgacttagagaatgccaaataaacaccctggcaactggtaatgaccttctgggagattctgacagattaaggtttcacaacaaacacagataaaagacaatttttcagaagacaatggtgaaggaactgagtaagtaaagcataactgaaggcagtagaggtagttgagtggaaatgcatagagagctgggaggagtggagttcaccagcaaatgtgtcttgtgtatctggctgggaggtgtaattgggatggagaaaggaagggcagcatgcaggaagtcatgtgataggaatagagctgtgtgccaggggtggcaagttgactctgttggttggtaccaagagtttgccttactgtagttagacagagttagtttttgttctgaatgagacaccgactttcccatatttcccgataggggttttgaatatagtgacttgaagcaagaacattattggaactatggtatcagatttcctgaaggtcacattattcattaataataatgttgctctttgagcccttaaaattggcctttttctagactcctaaactctatatgttcttaatgaaataacgctggctagagcccttaccaaaccctgaccagaaacagtgaattaaaagatacagaagactgggagctagaagttgttttttttttttttttttcaaacccatattgtctcgaaaacatctaccttaggatctattcacatccttattcacatgccaactccttgattcatttgcaagattgccaccctccttgctatttacaataattcattctttaatttcaaatttttatgctattttcatattgtttaaatgaggttctctacctacccaacatggtagctatttgcctaatatcttagttgtacctaaacattgtggaaggtagtttcttttataaatttaaaatgtttggcttttcaaacccctgttttctcatcttcctttgtcagagttctgtttgaggtgaccaaagccacttggatcctgatttagtggatgatttcagtgaaattaagactttgggattgacttttctctcccccccactcatcacagtgggaatgcatttttcatcttttctgtggggtgatttggagaatgactgagatggttattccttttttcctcctgtttcagtctgttctgtgctgtaatgacagaatacttgagactgggtaatttataaggaatagaattttatttctcaccgttctggaggtgactgggaagtccacgatcaaggtgccagcatttggtttagggagcatttggtgaggaccctcttgctgcatcctcatctggcagaaggcataagtgcaagtcatccaaatgcggagtgaagcctcttttataagagccttaatcccatcgagagggagaagccatcatggcttaatcacctttaaaggctccacttgtaaataccatcactttggcaacacctaaattttggaagggacacattcaaaccataacaccccctgtcacctattgtctgccctccttttgggagtgggcagtggtgctgactgacagatggatcctccaggcttccttgccctctggcttctaactggattggccaagggggaacttaaggagagctaagagtgggaggggagagagctgccagtcgccatatctcttctctctgcctgcttctctgctgcagttttgtcagtgactgtgtcccaccaagaaaccactcttgcctggtgggtcctctttcaggcctccagcaggttactttcctctccttgatgcttcgagtcactttctacctgaatgccccttgtggtacccttcacccttccctcatctttgtaaatagtccttcagtcagatgtcttcattgaaactatgtgagttgcctctatgtagtacatgtaagacactgttaattaaaagtacaggtaagacactgtggtatcaacactttaatatgaggaaacacatagcacattaaatgtacatgattataagatatgtcttaatttcagatacattaatacttagaaacaacacccatgactcttaaaacagagggaaacctatgaaattgctactggtttttcattgtgttaaagataccataataaatgtctttatttataaacttgcctatatttgagattatgtccataggatagatgagaagagagttatggacattttctaagacttgtttctttttgccgcattgcattctaaaagggtaaaacatatttagagtgccacctgcagcttcttagctcttgtttgactgtccccctgacagcaatgtgtgttgacttttccacaaatctttcctaatctgataggccaaagagagtctttccatttggaagtgaaagtgaacattttctattttattaacaggttgtatttttcttttactttaaaaaaatctcttttgcctatttatttattgggtcttactgtttttcatatgcatgagctctttgtgtagtaggtcagaggttagctaactttttctataaaggaccagataatagacacttcaggctttgtgggccatacagcttctgtagggtgaaagcagccttagacaataggcaactaatgaggatggctgtgctcccatatggacgctgagatgtgagtattatatagttttttatatgccctggagtatcattcctctttatttttttagccatttaaaaatgtaaaaaccattcttagctcacgggctgtagaagaacaggcggtgggctggatttgattagcgggccatagtttgctgacccttgtaatagatgataactcatttaatttattttgactattttcctcacttccttttttagataaattttttaggcctacagaagtttgaatttcttacaacatcaaattttaaatttctgaccatttttgtcatgattctgaaagttagaatgttcttactaacgatcatatccaaaaatacacgacttaattttagcttcggagacaatgttttttaaagaattcgcttttattcatgtggaatctagttgtgtatagtgtgatttggaggtctaaatttaatttttttgcaagcagcaaaccaattgtgggttgcttttgaatcctcctggttagtactgggttcactaactgtgctttgggtacctttgattctagatttacagcatgataattttcccacttttcatttatgttcaagaagtatggtaccaaactgtgacatgagttcctcttagttcttcttggctcatctgtttccatatgagctggcattcacaggaaattcagaactcttacaggcataatattaatagatacatgtggaaagagttgttctctgaaaaaaaaattttgactttttttttttttaatgaagaatgacaacttgatctcccacactaggaaagaaaagtgcaattaatagtttatattacataacattaactgttgggttttttttttttttggcctttggaagatacactcaaatttgtgataagtaaaatgacttatttatcacaggttaccatataagattggacaagaacgatcttttatttctagtcttttaggttgttggagtgacctaaaatgtaatttgaggataagcaaaaccctgatctgctgaaaattacaaaaccaaatttgcaggcatggctttcttgctcctgagactgaaaaatttgtctgcttccaattcagttgactataaagaatagatagcatgcttttattttctgacagcactaagagttattcctgctgaaccaggaatgctgttagagtgtcaaggatggatttgccttaacttatttttccacaaagctgtaatttaaaaaaaatctgttaacatttctttgtaattctttggttcacagtagacagtcccactgcagaagtcctgctccggtcagcccgtatttccagagtgttctttcagaactggaaatgtctgtatattcagctgggttgccatggtgctgtgggacatgaggtggcaaaccctacacaagagttaaagagatgagtagtgcttaggatacagattacagaaagtacagcttgccatcaagttctaggcaagagatagaactaaatgtcttaatcctaagaggaaaaacttcattccaagggacattgggtttagatgagattcattgttagattatgccccagatggcctgttagctttcttaggaaacttgttcccattttgtgtctccacaatggttctcagctactatctggaccagtcccttaaaattaaaagttaaattagatgtgatgtgatttgaaatttgaaacctatgtttttatttaactagactacaatggtacacttagaatttttgttcaacttccccacccaatatgaatttggagaaaaacaagaatgactaaaaaatcagcaggctcacatgaaattgagaggacggtttggaaatctccttgaatttctttttgtaagccaaatttatttttataagcctttaacggaagacagtttgttctttggataattggcccaggctttatcctcctctttcaaatatgcttcaaccaaatacccaactgtgagatgaataggataaatgaaggtgggagtcgtagagtggtgggggtgggtgggccagggggcggggcggcggcaggcaaaacagtcatgtggaatcttttgtttcatttttaaaataattcttaagagctgctgtctttcgacagagtcagaaagtccttgcttaagtgtatttgtcactatagagagtgaatgggattctgaagtctttaacgtggttctgtaaatgtaagtcttgttgtttaatcacggcatttctgcaaaaatgaactcctgtacccacatccctccccctctcctttattttagtgtcttagaactcagctaagcatttgaacagtcattgctaagtgtttccacactgggggagctagaagaacttggctggatagaattctgattttcatgggagggaattagttttccgttttctgccttagaagtcatatactatacttgctatttgggctgaactgacttgaaaagtcaaacaggaatgagtctagctactaaatttagagaactgattcgtaatttcttgatctaatacagtgggcagtcttgtcattgaccagttatttatttcagtgtttgccaaacctagaatgaaatccaaggctgctgcttaaccctctatagctctggtagttcatttctacttctcctgctcatttccgaagataacatgtatccagagagcctgtgaggtcctggcttagatgagtcctgcatatcagggcaaacttccatgcctctggacatctttcacatttcagacattgtcttatttctttttcttatccagttaacaagtatgtttttatttaagtcaggctttaactctcccctctctcccctctcccctcctcaagggaaatttaaattaagtgggaaattactttttgtatagatgttcttttgtcttaaattcatgctcatgtgactttccacttgccatttagagtaacagttattcaaagagcattacctaaattccatcattaagaaaaaaacttatgcccctgctctgctccttcacccctcatcattatttttaaagctctctaaatgcctgtcttgcttaaagaatcataagactatggaagtggaatgcacttggcatgttgttcactattccatgaatttgtagactaaatatgttatttctgtggctcatccagaagatgttgtcatcctttaaaattgcaattagcattattgtaaaattcgttgatggaaaaagatctattaaggttacgtgtattttggatttaatgttgctttacctaaggatgttagggttcaccaaatcctgctttgcttgggatatgcagggaggaaaattgagaagaaatctttttttttcccattaataaatgaaagaacttcaatgtgaagaatttaaaaaagtcccaagcacagatggttcacctgggtaatttgcaaggaaactggatgagcataatgtaggtggggaagacttagggaaattattcggatagttcagttcctttccttttatctgtctgagccagttagggggaaaaaaaaaaatgaggtttttggatgtcagaattacctgctggaatttttcatgcacttttcagaataaaaaacgtcaaaagagagaagttaaattttccagtatgttttaagaaaataaacaaaatgagacatgctggggaaagtgataggacactttcaggttgtgaacctcagggagtttcctggctaagacaggtggcttggagttttccctctttctccttctctcctcccttctactttacttttctccctctcttcctcctttttttttcttttatttgcacacccagaagcatggacctttccttcttttggtccttctatccatcagggtcaggtctttcaagataagtggacacaataccactgaatctgtaaacttctgatttgtatgtcattcttctctgtgagccagcgttgtcactggtttaaaaaaaataaaagctttggctgggtgcagtggctcacacctgtaatcccagcaccttgggagaccaaggcaggcggatcacctgaggtcaggagttcaagaccagcctggccaacatggcaaaacctcatctctactaaaaaatacaaaaactatctgggtgtggtggcaggtgcctgtaatcccagccttgggaggctgaggcgggagaattgcttgaacctgggaggtggaggttttgcagtgagccgagattgagccgctgcactccagcctgggcaacagagtgagactccatctcgaaaaaaaataaataaaataaaagcctcagcatgttgtcctctggcctgcgaacttgctgaagtattattccttgttgtatcccccaggctatgttgctgtctagcctgtgaataaggcaaattccatattatggaggtagtgggctgtgtgaaaagagcacagattttttatatgatgagttacacgacttaaggctaagtacctaatttgtaagtcctcatctgtaaaataagaataatatctagttcaaagagatgcgagaattataaattctcctatgtaagatgctttatatattgcttggtatacttggtaggtcctcaagaaatgtttgtttcttttctgctaggtctctagtaattggaattttggatgactgaacattcaaactgatgatttttggatgattaacattcaactgattttttgagcaattaatatgtaaggcttttctaagtcctgagggaggtaaaacatgaatgataggtagcatttgcatgcacaggcactgttttaagccatgtgtacattttatctggctttatcttctatacacagttatgagatatgcaccattatctccagtttattgataaagaaatagtatagaggattgatttatctgagaccacacagctagtaagtggtacagttcgctgaggcataaagagagaaactgatacatgtaatacaaggcataacatggtacttatttttaaaaagggtgaacatgaccagatgattgagaagagaaggcaattgtatttggtttgggtaggaaaattaggacaggcttcagggagaggatgtcatttgagctgggcatagaaggaattgagtgtgttgtggagagacaaacatgggagccaaagagagaagaatgtggtggccacggagacaggaacacttgggtgctgccccagagcagcagacagcttcactggctttctgaagaatactggatgtgtgataaacaatcccagaagctgcccctggaccctgagctggtgctgggatcccagacctgaggtcgggtttgagagtgaggcttcctctgcccagggttgccacgtggcagtggtggaggctgaacattgatagagaagtgaaatcagaaggtaggtgactaatccaaataaaagttgtggatctgagggtggaggagtagaaggtggcagcacaggatgagggaggatgtttgaaatgatggttgaaagggggaagcctagagaagtttgtgagccccggatggtctctgctgtgcctttttaatagatgctggtccctctggacgtgggtgaggagcagcttattaagtattttcttcatagtattgaaaggaagtaggagacaaaagcctgggtggggaacctgagatggggtgttggacccatggaacctacctgccagtgtcaaggtagaggtggaaggatttgataggctgttgaccagttttttttctggggttggcagtgaagtagtgacataatggggattatgcttgaggaagattgatctgccatttgtatggggatggattaggttatttagactttagggagggaacttgtattggtgcctttacaccttggggcagaatttgtaaggctttgcaatcgattcgattgagaggctgggaagtgaggaagcagttaaagatgaccttaatgtctttaatagtgtttctatatgtattagatatttgggtgagttctatgtggcaggtggagtgctagctactggatgaagagtgctgagcaaaactgtgtgagtagataggtggggaggaagtggaatgaaagtggctcttggggtttgaacctgggtcctggggaaagtggtgtgacatttactgaaacaggacaggcagcagaggagtcggcttagaagccctgatgatgcattttgttttgatgagttgagtttgaggttgatcacagcaagtgatcaatcataaaattagacatcttggatagagattggagatggcaacagatagaaagtgggttgaaaaacaaagaatgggccgggcgcagtggctcatgcctgtggtcccagcactttgggaagccgaggcgggcggatcacttgaggtcggggtttaagactagcctggccaacatggcgaaactccgtctctaataaaaaatacaaaaagcagctggatgtggtggcacatgcctgcagtcccagctactctgtgggctgaggcagaagaatcgcttgaatccaggaggtggaggaggttgcagtgagctgagatcgcgccactgcactccaggcctgggtgacagagccagactcggtctcaaaaaaacaaaaaaaataaaaaaaataaagaatgctcttttagagattcaagggaagcaggcagagggtatggccttatgagcaaaacttaaattttagggggcagaaggaagatgctgcaaagagtatggaggaggaatcagtataacttgtatatttctacctacctgttttcttgtgcagtttgtttcctttatggctttagaacaaggtttcttaaccttaacactatttatgcatttgggaccagataactgttatgtcataggtgtgtcctgtgctttgtaggatgctgagtggcacccctggtccctgcccactataggccactgagtagcactgcctcttcccaattatgtcaaccaaaaatgtctgtagactgctgaatatgccctggggggcagtcacccatagttgagccccactgctttaggggtaatgattttgtagttttctttcttttttcttcccacgtgtatcctgcccaaaccacagccagggaggaattggaggcaggcgatgccagcaaaagggttgaaccttcatttggctgcaaggagtatgtgactcagttctcaataaagttacatgtaggaagatgttgggaattatcctgtgaaacagtttcatgtactaggagaagtgtgaactgctaagactatttcattgtagctctcaacaggcctgggcctgtgatatgactgcatttatggacactggggtgggatggagtggagggaattttagctctgaaagtttggggaatttatcagtttcaaaaagtattattttacagaagtccctatgtagttcttcaatgcctttaggagaagctattaatttaaatgtgtcctgtcaaagaaaataaatgtgtgtcctaataaaggtccctaaaagttcacgttggacatctcacccctccaaatgaagtgacacaggaggcatacacagtcctagtggtttctgcatacctggcacactgccttttcacctggtagatgcccatgagttagttgagttgaattgaaatcccacctgtcatttatgcttgaagaattcttcctttttgatcttgaaaggggaaggagaagtgcttggaggcaaaaagctttaatctgtgcaaaatatcaaagaataagttcatgaccatgtcagcggcattcacagtttcatttgaaatctttatttagagattggccttggatttgggtgtgcttgttaggtcagtggaggggaggctgttgattcaggttggggcttttttccatttcttagagttctccaggtgctcctctcctgcctttgagcctaaagttcatttctgacaggtgcttgatgaagtggttattataatcagtttggcctaatacgctattcataaaacttgaaaattgaccaaaaagagagaggcagagaaaaaaactgaactatttttaggtagtttcagatgttgtgtttaatctttttttttttttttttttttttttgagacggagtctctttctgtcacccaggctggaatgcagtggcgcgatctcagctcactgcaacctccgcctcccgggctcacatgccattctcctgcctcagcctcctgagtagctgggactacaggcacatgccacccagctaattttttgtatttttagtagagacagggtttcaccatgttagccaggatggtctcgatctcctgacctcatgatccgcccgccttggcctcccaaagtgctgagattacaggcgtgagccactacgcccggccgtgtttgatcttttaaaagcccataaatgctaagcgttgttctcatctgtaaatagtggtgaaacatgaaggtatgaacaggtgtgctctaagtcagagggcggagtggaggggaacctgcatgaagtatctttccttagcaggccaggcacattccctgctgtttttggggagcgggctccaggatcctttccctcttggaaaagagcagaaagtgccaattggatctctggtcactgaataaaactgatctaccctctgagtgtggcccagctcttaacaggagcaaattgagacctcaactgaattctgccttgaagatcttttgtgatgtttactggtccacgaagacaggagagtgagggtaggaaggtgcaaggacagatagttgctgccaaaatgaatttggccaggttcattcatctgctctcccttgcacacagctctctcattccttcctctttgactttttaaaaaataaactttttgttgtagtatagtttcagatgtatgggaaaaatgaggctataatacagagaattcccacatatcctgtatctagtttcccccattattatcttaagttagaatggtatgtttatcacacttaatgagccaatacagttaccttataattagctaaagtctgtgctttattcacctttcctcagttgatacttaatgttctttttcggtccggggatcccatccaggatgcggtgtcacatttagttgtcgtggagccccaggctatttttggttgtgacagtgtcccagactttccttgtttttgatgatcttgacagtttcgaggagtactggtcaggtgttttgtagaatacccctcaattgagatttgtctgttgtttttctgtggcgattcaactggggttgtggattttgagggggaggatgacagaggtaaagtgccattttcatcacatatcagtgtgacttatcacatgctgatccttatcacttggcggaggtagcgtttgccaagtttctgtactgtaaactgaaaaaaaaaaaaaacccacaaaactgtaaaaacaacaagcaaaaacccaaacagctctgtcatcttcagaaggacgtcactgtgtacagcgtacacttgaggagtgggatgttgagagaggaggatctatctaacttatttggaattcttctgcctgggagatttgtctcttcttccccatttatgtattcagtcatttgtatcagtgtggactcatggatgtttttatcctttgggttagaatctaatactgctttattttgtttgaatcgtttcagctttgaccattgggagctccttacttggcttctgtgtccctttcttggcatacactcattttttttttttaagtacttcctttctggcactacagaattcctctttgactttttgtgtgcctttgtaatgctttctgcctggtgtaggagtagtgacagatcacatacttggtggcctgaaagctaaggttttggtctcagctctgctgcccaattcacgtcacctttgtgaccctgttgtctctaaaatgatctttagctaacagaattataagaaataaatgtagggccgggcacagtggctcacgcctgtaatcccagcactttgggatgccaaggtgggtagatcatgaggccaagagattgagaccaacctggccaacatggtgaaaccccctctctactaaaaatgcaaaaattagttggacatggtggtgagcccctgtagtcccagcttcttgggaggctgaggcaggagaattgcttgaacccaggaggcagaggttgcagtgagccgagatcacgccactgcactgcagcctggtgacagagcgagactccgtctcaataaataaataaataaatgtaaaaggacttcacacattggttatcaatccataccccccgccttttttttggacattgaagcacatcttcagacttccatctctgggtctttctgcagccccagaacatgtttattgaatgaattaatgcatcttcaatgaatgtaactgttactactgtgtatcatcggtttgttcagttaaatacgtatcaatggacaagcttttcctttcctacataaacattttgttttttggttatcttgtatctcctcacatcccatagcattgcagtggttcacaggcacttaacagagaaaggggacaccaagctgaatttaaatagaaaaaataatgaaatatatatcatctttggggataatgtcattttctgtttcttcctacaacttgagccctcagaattactcgtaatggggtgtttgtgtcatctgattgccaatgatggctgagtgagtgaatgcatatttggagtgacctggaattctgatgtaggtaagggattcagaaggattatgtttagattaatttttctgcagagttctccagcagagtcctaatcaaaaattggtggtggtggcggtggcagtggcagcagcattaaacacaacaaaggcagaacggatccttatttgcatcattcagtccagtgggtgccgttagctaccatcctagagtgggtgtggaataaattatatgtataaaatttttttgagaagaggaggatgagctggtcacatgtggcattttctcccatgttgaaataacatgagatggagaacattgtgtgttgatgtctatctacaagttgatttttgtcttaagataagcagagcctccctacaacaggccctgagtactgcatcaccttcctccagtttgaaaaactgacgggggttcttaccagtctttgttaattcctgtctccggaaagaatggttggtaaaggcacatccgtattctgacatgttgagaaagaaaggatacatgcttgggaacagaagttgaggctgtaaattgttggtggtcttactagtattgggaggctgttttatccctggcatctagctgcttgtatggacgctggggttctagaaataagtttttactcctttggctataatgagctgggcattatcattaactagaaggctggattggaaaggtttgggaagcaaaggtccttctgacattcaacgcatcttcctttctggtcttttttggagcagatttttcttctgtgctctctaggaagctgatgtggttcctgtcctccaactgaccagtacctagaatgtcaacagaatgactcatgtccccaacatcctgtccttgttctggagaaagggaactgtttgcctttggaaaacacagtgcttacctctggaaaaaccccaaagcaagcatagcttcaacacagttttccttaaagctcttgtgatgtcttgtgattttttttccttgtgactttttgtaatgaaagtgttggttttcctgtgtctaccttgcgtgccaggtggttgagaattagggagctttaggtgttggaaaggaccctagagaccaactggtccaactcctctttatggttttagaaacaaaggccaagttgaagtaaagtgacttgagatctagaaactggtcagtgataatcaggactaattagtacctgggtctcctgattcctggttctgggtctttgatttttatggtttgcagtaggtttttgaacagttcacttggctgccttattggaagttctatctatgcagaatgatattgatatgggtggatatttaaaactacatatattataacatagtaaagtctttaagaatacatgatatacattgagttgttattcagaagctagggggatgtagaagagtaagaattcttctgattttcaggacattctgtcataatttagccttaagacagattttgggcaaggtatatatatctcttgtgactacaaaaggaggctggattagattagtttcatttgttgtttcaggctctgaaatgttatgattccctatgtctataagtgtatgctgcacatttttttccttcagtagtagagaatgtctgcaatgtggttaaatccttattctttaattccagtattatagaatatgggttccatgtaatttacattcatgttgtttttcttgtcaaagagggaactgagatagttatctactgtgttcagtagcattttgagtggggagagagagctatagtgtaagcttgaacttgagcagacattagcactctgttaggttacaattggtgttaacagtagagaaaagaatcagaggaagaggaggaaagagactggtgtgtgggagctaaggcccattattttgttatgggcttcttccccttttgagtgacttaaatgatgtgattgaagatatttgatagctccatcaagatggtagtctcaattccttctacagcccacactttctcctcctagatttgaattgttatgatggtagcataatttttgacaaatgatgtttgtgtggaagtgtaccttttatctgagttgagtcattgcttttgatattatcacctccattttacagatgagcaaatttagtctgagagaatggttaaatttagaatttaaccatatgaccttccaggcaccacgtactgttccactttaagtctaagacgtttcatttacattttgttcttactgatttagaaaagtttattgttttcattttctcacattacttcctggtgcctggcataggactataactgaaacatttttataaatgatttaaaggtattgaatgtgatgaactggaaaagaagaaaaaagcttcctgagtcacccagacttcatcctggctctgtcactttgtaatcttgagaggaaagattaacttctctaagcatcagttttcccacctgaaaaagtcaggaaaatattattttccatactgggttgctgggacgattagaaaccgagcatctgaaaactctttgcacagtgcttaaggtaattaatgagtgtttgtcattatacttatgttgatgttaaattaacatcttaaagaactctaaaatatttttcactttctgtttttgttttttttttctttccccctgaagcttcagaatgtcatttcctctaaatgcctgccaccctcagggagttctagtaatagggtgaacataacatcaatggaatatgaggagttactattagcagatgctatttgtttcccttttcatttctttttttacagtcgtttgggagaaacccttccagccctgggcgatgcggtgtgtcagtgtctgcctttctgccgactcctgacagcgcctcccttcaggggtgtgggtggagctcttcatgcctgcccctcctgctcacatttctcggttcactggaaaagtccccaaatctttttgtctgctcagttgtggcctagtagccagagtggctcgtgcattaaacgaagaggaacctatgtttcttctcttttcagcattttggctgaattttgaatttttatctgccccattgagtctgttggctctggctgctgctgtaccaagccctctttctggtgttcataaaccaatgagagtacaatttcatggcctgggtcaggcttgtttgttggtttcgtcttaattagaagcaaacctctttgtcttcccttttcttcatcttccagggagaaatggattttctaggctgagcaaattaatcatagtggtgtctaataaaaaacaatcaccactgcagtacctggcacacagtaggtactcagtagctgaaagaaacagttcctgtagctcttccaaggtatccagcattttgtgcaggtaggctgggggctgctgaaggatctgtttgtgaaagacgagaattagcttaagtaacttgggttggaaaagtcactctgccttctgagtgacatatgggggctggaaggtggcagagaacagggttggagagtttctctggtaggtggattagtgttgttcccagctcagaataaggtacatatttgaaagttacttaacacagagccttggattctgcctgtaggataatagatattgagtagttgtgataagtaatcatatgtagcacttaggtctttttatcttcaaagaacttttttaaaaaaaacacttttaaacacaatgaattctaccttgtatctttatcgtagccctaatgttctcttctgtgtctttgtcgtattatgtttcttaggacaagtgagtaagctttgtcaattggtttataaaacatttatgcatttaaagcttccagggagtgagaattgaaattacagtatctggggcttcatatttgctggcaaactgctggcttagcattttcttccctcttgtctgtttttcccaagctatagcagagattaaatgaaatttaggaattgtgtgtgagattttgtttctccttgaaatacagatgctcctagacttacgggtttttttttgccctgataaacccattgtaagttgaaaatattgacaatattgtaagtcaaaaatgcatttaatatagctaccctatgaaacatcctagcctagactaccttaaacatgctgagaacactgacattagcctatagttggcaaaaccatctaacacaaagcctattataataaagtgttgaatatctcatgtaatttattgaatactgtactgaaattgaaaaaacagaatggtcgtatgggtactggaattatggtttctactgaatatatatcgcttttgcaccattgtaaaattggaaaattgtaagtcagggaccatctgtagttctgtcaggatgggtgaaatgcttgctgtgcagtgcattgatttctaaagtcaatccttagcagatactttaaaacaacaaagaactagaagtttcctggttaagagggaagaagggtttgcaattggcttcataaatttcttctcaggcttttaaagttatgagtcaagaaccttcgaagcagtgttcgtaggtgcatcctttccttcctcaccccatatttcatttatataacaagatacttcaaagatgctccaaagaaataaagacagtataattccaaatgattagctcaaatccgactgccacattcaaggcttaaaaaaaattctcaattgctgtgagggattagaaaaatggcagctggcaaaaatgccttcagtataaagatgataagacgccacttattaattctttatataagcaatggttttttttggtgaggatatggagaaaggtaataaaatcatggtctctgctgtgggtaaaactagtttgagagcccctcccctgctgcttttttcagaagtttaaaaaggaggtcaggagcagagagttagtttccctgactgggggaagttaaggaaaggagtgtgagtgaggtcatggagaaggcatggtgaagtttcacagtcttgtggataagtttcccatttgatatgggatatagttgagagttacatcaaatggagttgccaccaacatgactgctaatggtgactctgggtacagaggacatggcatagtagtagttatgcagtaatcggaccctgattaacgatgaagctgatgatggcattgatactttatggagaactttgtatgtgtttttcccccatttaatccttacagtcaccattttcagatggtagctgggagtagtagataattttcccagggtcatattgcttaggggcaaagctgggatttgtaaccatgatgcaatactgcacctggtggatgtagtcagggttatcaaaataaagaaaaattgacccaaagatatattttagaggcagaaacaataatagcttagtaatagtctaggtgtgtgaactcgagacaaaacgagtaggaaaaagatggtttttaagtgacagttttggaaaagaagcaacgggggtggcaggaatgaacaatacagttctgtctcggtcatgtttatggactcttcttcctagagaacagccaatagtctttcatcagtgttgatttcatctttcagccttcagaaaacagctgtcaatccaagtgcttgctgtcgatatggagcacaggttgtgaacacagtgcctttgtgccatgctttggtcacatgtacaggtgttgactctagcagcagaccagtacctactcccagtggagctcaaattcacacatcacaccatcacattgtcttctcatttagccagtgaaatgattggcgtctcactgcagtagtacagtgatagtcattgattgacaagaccttctctgggaaggactacatttattctgatttctccagatcagacttttagaaccaggagaggaagtctgttcatggtcagagttcttgctgagtcaatgtagtattttgaaagctattgtgccaaggccccaggattctcagacctggctgagcaacatgtaactgatccaatttctcactgactcaggaggaatgctagctaaatcttgaatttggtactgtgacttcaatagtgggccagtcaaggggctcacgcctggtggaccaccatcccttcacccccaccccaccaaggtctgtctgtgcttggcttttcggactcatggtgaatgcttgaacctttttattcccttaacataaacttattcttctgggtaaaaaagtgaatcctatccccatgaaggatttgcttgattgaaatgagacccccccttgggagagaagtataaatgttgtgagcagagtggccttacggtagcttgctgacttcctagaggggtcgttgtgggaggagagccctgctagttccctttgccccaaattatttcccctctgtgcttgctacagaatcactaagtgtactgatagctcttaattacttctagttaaagaagagcaagccacctggtctctgaattaattagagcaatactctttaaaagaaacatcctcctttccctccttctttgccccccagcaaaatatttcctattagaaaaaacatatgaagccattggttagttttcacttcctttcctaagggatagtcagctaaatatgctgtcctgagagaatttgacagaagcagataagatttttgataagagttgaagagaaattctgggaagggaaggtaaattatactccctaataaaagccctaacaaacagcaggcataattggttgtgtatttgggggtgtgtgtgtcagtgaagtggtgtgtattctacataccaccagtgggaggaagaatgctgaaaaaagagaagtaggtgcttgctcaagacaggaaatataccacttcccttaggaatctgcccataggccatctttgcttatattatccatgcatttcattggcagtactctcctggagtgagaagtggtgtatgaagttggtcctaaaatccactcctcccatctccttcctaagagaaagttaacccactttgggctaactcaagagccagccagttatttttgcccatcactgtaagtaggattacagctcaccttaaatattggggaaaagtcctgatcatttgttcattctattagctagggccaggtgttgtcactgtctctagcaccgcttccatttcactcccattaaatcttagcaaattcctagcactctgaacagtgtattttacttgaatgattcccatgtggccagacttctgggagctgagcacatggtacccttttattgggtgccatgaggtaaccttggtaccctttggacattcagctttcctttgaggttatagctaattctctgatgaacatttaagtgggtggggctgtgtgttagccctactgtgtagcttttgtgatccagggaggtgtgaccccattgtggtattcccatagctgagatcataaaagcatcccaagtgtcatttggaagccaaacagtaggttacaaactcattttgggttaatctccctctccctaagctacttcatctccttgaatgctgctaactgtaagcttttatttcctttcctgtgttatcactcattaaagccttctctgacctgtataaatgagactggctttttcctcttagtattgtcttcgagcacttggcaggtggcatttggagccagagcctgatgaaagttgcccttgtgtattgtttttataagctaaatgagaggcacagaaagaataccaaaagatagactttttccctagggtaggaggaaaaaggaggatcaaaaatttgcagtttatgtatgaattttggtggaatgccgtttagagggaatattttctgattctgtctcttctcccttcagtcttatatttcctcttactttcttctgtatattttatatatatatatatatatatatatatatatatatatatatatatatatatatataaattagaaaaaaattgaaacagggccaggtacggtgactcatgcttataatcccagcacttgggaaggcagaggtgggcagattgctttagcccaggcattgaagaccagcctgggcaacatagcaagaccccatctcttaaaaaaaatacaaaaattagccaggtgtggttgtgtgcacctgtactcccagctacttgggaggctgaggtgggaggatcacttgaactcaggaggtgaggctgcagtgagccatgattgtgctgctgcactccaacctgggtgacacagtgagaccctgtctcaaaaaaaaagctaaactgaaatggaaattatttccatatcttttcttaaccaagtagtcaagtatttctgttgccattagtttggaccatatgaacttgctgctgttataggtcagaaatggttgaatagcagcaatctcatggctcaacctgttgaaccattaaccccaggagggttaatcagctagcccctttctaacccagcagatagaaaactatgacaaaactatttgactctactttccttccttcttatcttcctcatcttaaaaagttaacagatataaaacataaaagatatcattggcaagtcaaggtgacagtttttgggggtgggcaggtggcaacagacactaggacactaggacaatgaaacccagattttaaaacaaggatacaatagagccagcttctgtagaaattagtgtatttattcaccagtcattgtgtttagttgtctgagctacattgtattgtccttgaggagtaagaattgtgctatttttcattgcattcctgacatgcttaaaaaaaaaatgctgctacaatctactgtatgtagttgattgatgccgggaaagtttgctgcacctaacaatggtctttatccatgaaacactccattgatacttttagaactcattactgctaaccaaacagtagtggttttattactatactaatggagcctggtacttggaggctggggcatgggggaggaggagaaggtggggcaaggaatgtgggtaggactagtggatccctttccatgattaatggtgtcccccagaaaagtagttaggcagtttccaataaaacaatgtgataatctagatacaatgcagggtctaatgtgcatatgcaaggatgcactaaatgaattagccctaacagggaggaacaagggctttctaaataaagaatcagcaagacagcagagttttctatggccttctccaataaagtgatttgctttcctaacactgcatggaggcaaacaaatgagttgtgaaagatacggataccgatggacacagcaccatgataggcttggcagactcctccttgtgggcaacaagacagacccatgtggtgacttttatcctcttgcatgctttttgtgatgtacttgagttgttcttcttcctcactgtctttgtccatttaaaaaggatttttgtttttaggttattttatttggagtaatgcatctgtttgccataaatgtgattattgatgtacacgagcttatgtttgctgtcttacagtttgttttctatttgatctacctgttttatgtttttttttcctcctttttgactttggattaggcacagattttcagtccatttttcctatttctgaacctgctaactacacagtattttactcttcttgtggttatcctacagattataggatacgtctttgatttactacagtctaatacagactctttcacctctttgttttttgtatattgctttcctttggaaaagctcatgattcttaatgaatctcactgggggtggagtgatgttacccttatttcctacttgaatctctctcatagtagctcttacttgctgaacctgtttgtaactttcattaaagttattgcccagtatcacttctccgtggacatgtgttagtcagaaggggacatcctcaccgctgagctgtgagctccctagaataaagatggaagctttctggtttcccattgaggctgaaagctctttcatagcaaggactatcctgtctctttctagtatgacatctggcccacagtagcccctcaagtggagatttgaatgaccaggtccacctaaaccagatggccctggcatctggagagttcgaggccattttagctggagagttcgagctggagagttcgaggccattttaggtaagctcaagtctttacaactctgcaccttctaccagtccttcctagctgtttcttttggatgaagatgattcttcttttcctaactctgaggttgccctctttcatgtgcattcacattaactgtcagccatacctgtgtacctcaacactcactggttgctgcctgtaatactcttacaaaagatttaatgaagtgatggagaccttgggtgtctagcaactgccattgtttgtcaggggaatgtgagatatatgtgtgggaaggtccctgagttcctcttggacttatcaaaatatcacaaaattccagtacaaagtatctttccacagattcagctgtgctgtgggtcactaatacttgggtcattttaagctgtggtgcagaaacctacagcagaggtgtgaatcttcttccctttggcaactttatgtcagttctgatacattaaaaaaaaaaaacaaaaaaaccccagggattgatcatgttaatgtgaacacccacctctcagtgatggaggagtttttgaatcatgcaggttcttggctcggagacagcatggtctatacagaagcagcttggatttgtcaagacctcagttcaccacgcagctctgctgcattttgagtacctgtgggtaaatgacctcacctcttcagccttatctgtacaatagggatgataacactcagcttacttcacaggcttgttgtagggagaaggtgatctattgtttcctaaagctgtttttgaaaacggtgactcactctacagatatgatttgtgtcttctgttttctcctgcctgatgttttccattttggcaacttagaatctaggcatacctcaggtagagcttgctgacacactggtctatttttgaggtgggtaatactaatattgagttcaagagaattttttcccccctctgaactatgctatagttggtatctactcctaggatattaagtttgttccaaataagccagttgtgggctccatgctatgccatagaagtcagaggagagatagtgccgcctttaaacattgtaaactttcagagaaaagttttcccaagataaattagcaagtagtttcttcaccaaagggacatggttgatgtgaattgattctctgaagaaatatttaccatagctgcttctgccaaagtgaatgtggtcaccagggcaacaatggcagccgtctttatccagataagtgcaagagctgaattcagatgccccttcctagggctgccagctcatgtgaagtttggcatgcaggaaatggatgttcagtgttggcctcactgagttttggaaaaaccccacttattggagcatctgccaagcatggatggaggagggcttttcaggattgcaaaactacttctagagagactggtgagtagagggatagtgttatggacatacggctcattttccagaggtactattgaaactttcttcggtaaccataagggaagaggcagaagtcttctcatcttaccaggatgcctatgagagctggaggttgctggtgaaagaggatacaaagatacctccagagacagggcagggagtgtggtgtacttaccacatttctggaattgacttgggaagtggtgttcacttcttttatcaaagcaaaactagtaactaatagtaactactgactcatttattttttgtcttcagcttttatgaagaatgaactgactttctaatttctataagaaactgcaccagagtttatcccccactggagagggctgcttagatggttggcaaagcttccataacatctcagtttctctaacatttgaagtaaaagaccaaagctagaatcaaatatgttacttctttccattgcccagctgcagcttttacaaatgcatcacagttgaaagtgcctgaatctagagttgtccatgctgacttctagccaggccaggccagtggcacttctgtgatttggaggagactttcaatgaaattagattgtagctgctatatttaacttttaattatacactattgggatgttttaatttctaaagtgtcacagccaaggcatgaaaatgtggatcaagtaggcaaatggaattaaaaatacaacaacataacaaactctaacatccaccaattgtgtctcaggtaattaattagagcagcctgtagttactaacctgtgtggatgtttcactgctcgggaagaatagtcccagtgttttctagattagtggactgttccaaggagggctgaaataagtttcaacttgaatttgtagatctggatagtcaaaccttaacaatacaggcataggttgtcctctgtgggtatctgtagtgaattacaattctgtattaacttctacacgattacttatcctagtctcattagggaacacgaaattacctgaacaaaccataaggtagcatagacgttcaaatctgacatgtgcaaagttccttaagctaattagaaaatacacacattgatctgtgaatggatgcccttctgctcctttagggccagtgattgagaggtgtctgttggaggttggtgttgaacttgtgcttgaagtctccggatacaaaacttcacggttctggtttaagcagaagtcttcattgaatgacatcgatgtggagagaaaattccttggctttctgtcagctgaatctgctgatttgtaagactcttggggcaggttaacagccttgttggttgttgtgctgtgctgacagtgggaccaagcggggatcaggaaatagtctagggcattgcaaggttggatttgcttacattgaggtgttcctgtgatctgtgcacatcacccaaggtgatcagggccttgaggcttaggctgaaaggctggctttcgaggcaaaagatcagaaggaagaaaacatgctggcacctgatgtatatccccttttgctctgcttccatctacggttgctgcctgctcctctgacatgtaactcacctcctctgtgcctcatattgttagagctaaatttcccactgaacccagactgttatttttgacctgccctgcctatttatttgtgcaccagtgagtgtgtgagtaaatgcattatttttattattattattttttcttttgagacagagtcttgctctgtttgcccaggctggagtgcagtgtcatgatctcggctcactgatctcgctgattgaacctctgccttctgggtttaagcaattctcatgcctcagcctcccgagtaggtgggactacaggtgcttgccaccatgcctggctaattttttgtattttagtagagatggggtttcaccatgttgcccagggtggtctcgaactcctgagctcagataatctgcctgccttagactcccaaactgctaggattacaggcataagccactgcacccagcaaatgcattaatttttaaaaattatagcagctcttttggaagaattgaaacatagaaaaattaccccttagtccattgcatttacatggtgattttctttttcatttcattttttggccacgtttttaatttttattttttgctgtggtaaaacgttaagataaaatttaccatccttgccatttttaagcatacggttcagtggcattaagtacatttgtattgttggtggtgcaatgatcttcaccgtctgtgtccagaacttttcatgttcccaaactgaaactctctacccattaaacagtaactcttcattccccccaccccttcccctggtaaccactgttctccttctcagtccccatgaatatgcctattcaatgtaactcataagtggaatcagggaagttgtgtccttttgtgtctggttgatttcacttagtataatgttggtaaggttcattcttgttgtagcatttgtcagaatttcattcttttttaaggctgaacagtaatactccattgcatggatagaaacctcattttgtttatctatgcatctattgatggacatatgagttgtttctacctttaggttattctacataatgctactatgaacattggttacaagtatctgtttaagtttctgctttcagtacttttgagtatgtaactggaagtggagttgctgaatcatatggtaattctatgtttagctttgtgaggaagcatcatactgtttccacggtgtctgctgcaccctagcaatgcacgagggttccgagccctccatatccttatatgcttgcaaaggatatgtgtcttttcctttttttttttttttaataatagtcattctgatgggtatgaaacagcatctcattgtggttttgatttgtacttatgcataggttttttaaaactatgtttaaacagagtgtacttatttttcatccttgatcagttaatattttgtcatgttctctttttgcctttcaaaggactttttttgttttttattatatatggacaaattatagttgcaaatacttaagggggtacaaagtgatgtaatgatgtttgaactcaatgtggaatgattaaatcaagctacctaacctattcacctcaaatatttaacttttttataacatttgagattttctcctagtgatatcgaaatgtacagtatgctattattgtatttaccatgctgtggaatagccctcaaaaaaggaagaaattctgtcatttgcgacaacatgagtggaattagaaaacatgctaagtgaagtaagcgaaacacagaaagacaccacatgttcttacatatgtgggatcaaaacaatcgaattcatagaggcagaaagtagatgagtggttaccaggggctgggggaaatggtaacgtgatggtcaaagggtaccaagcctcaggaggagtaaattaatttatttttgagatctaaaatgactaattttaatagcttttttctgggatccatcctgaagttaccagttttctgaagaaaagcatttgaaccaagaatccaaatgtgggcttcactacagaaaggagaaacacagggcaaaactgtgtctaggcgcccctgagaccaccccaggaggactgttgggctccctgtgacctgttttggaactctgggggagctttatcagggaatacacttgctggaagctgcagaatatgggagagactccgattgtaacaggcaagtttctggtgagacaaaaatggattaaaccaagactaatgccaggcatcagagacagcaaaatcatccaatttatcatccttccctcaaggctgagaggtttttaagtagtttggaaaaacttggaaagggatagggaaagcttgagaataatttaaaaacttgtcccctgcaggccagtttgctaaaagccgagttttaccaaaaggctaaagcagtaattaaagcaaaaagcctttgaaaaggaatcttgaactaccccattaacagagattacagggtatggttagtaaacaccagagtatttaaaagagagtagtgacacagaaatgaatgccttgtgaaaagacgaatttggtcaccacaaattatagaaactttcagaatatacagagaatgcctgtaagccaaatggaactgttggtagaactgagttaaaaagtgttttctgtagagtttcatttgtaaacgtgatttttaagagtacaagctgaatattacttaaaatgccagtaggaaaaaaagtcacacccctttcctagtaactgctttttgaacctgaagtttttggaaagaagcatcggtttctgagtatgatctgaaagtactggctttaataaggtctttctccgagaattgttgcttatcttacaaggcagaagtgacaaggatggtactcagcactggggcattgggtatcaatggtgagctcatctctgtttcaggaaggagctgaccagcgacatctcattccaaaaattgccagatagatgcagcactgagctgcctcccaggtcatcccaactgattaatgtggagatctgcagactaaagcaaagagaaaagtgatttgaatggacctgagggactttatcctccactatgaggttgcagggggtgccttctgtgacggtacctttgtaagttattacaaacctactggtggaaaaaccttgactgagttccactctgaatcccagttgtagaagcatcatgaaattgagcacaggaaagactaggagtaggaagaactgggtttcggactcagatttgcctgttattcgcctgagatgtctggcgttggttgcttgcctttctgcaaggattgtagggtaccgtccaacgcatcttgtatgtggggacattttggaaacacataatactgtgtaagcattgttattagtaggtaaaatggtaaaactgaaatgaaacaacgccctgcccagccccgccaccctaacaactcatttcccctttaggcattttcttgtcagtgggtacaacacttctgtcagtatctttggctctgaggaagtcagtggaatgaatgacttcaagtctttgaaaaataaattcatggcttactgtgggcagtaatttgttttatcccaaagccggtaatgtgaggtatttgaaccaaccacaaattaattatcctactatatttgcagcagtgttagggttacaggtacaacctaagcaccattgccatatcattctgtttctggacaattaataacatgcaaccgtgttgggacaacaaatcagtgctaacctctctggggaaactcaagtgcaattgtgagatgtaaatctccatccacaggctctgcaaagggggaaatataggagtggctacttactatgtgaaatgcacagacatgactaagagtagagagttgtatattctgcctcccaaaatcctcctcatgtggctttctccaaagccttctcagaggacactgaattcacctaggaacttcgagaaatgtgagatgattcaattctgttggcagcagtgcctttcctgttactgattactggctacccgggagctcatttcctttgtactgagtcatgtgcactcagagagatatgaccagggagtgatgttatagaaattgcgtaagtgtagagaaaaggtttggttcccttattttgcatgatgatctctcactgtgcattttattatgtttatatttaactatgaagtaattgctattactgcactactgtgtttgatgcctaccctgtgtcaaacattaggtattttacgtttattatctccaatcctaagtaatgccttcaagctaggtaggtttattgatgaggaaaccggtgtggataggtcaaaataaactgttttaggccatgcaggctgaatttgaaatcatctaatcacctttgtaaatctgacagggcctgagctctttaggtcaaacctgctgcctcccatgtttaggggaataggcttaagaagttcagggaaagtacttgcctgttgaggcatgttttcttagttacaaagggcttaaattgttttgtgggtatgtgaaacattcttcccagaagctgaaagcctcctagggattccctcgttctgtgttttgcccattctttaagtcacggatgcccaatgtgaagagatcacatatgttcatgatgccccgtgatcatcattgtcatgctgttgcctgaagggggaccaggaatagattggcatcctggattttgtgacttaatagttgattcattggataaatggttgtctcattctttttttgttaatggctttattgaggtatactttaaatgccataaaattcactcattttaaagtatagaccgaaatgatttttttgtgggggagttttccttgggagacagggtcttgcactgtcacccaagctgaagtgtaatgacaccatcttggctcactgcatcttctgcctccgggctcacctcaagccatcctcctatctcagcctccccaggagctgggactacaggcatgcaccatcacgcccggctaatttttgtattttttgtagagacttgattttgccatgtttcccaggctggtcttgaactcctgagctcaaggaattcacccgcctaggctcctaaagtactgggattacaggcgtgagccaccgcaaccggccttgaatgatttttagtagatttacagagtggtgccaccattgccacaatctaatttggaaatacttccattgccccaaaagaaactttgcaacagttgtgtcagttttaaactgctcttttaaggtacccttctctgatgtgctattaggttctctagctggctatgaagaagaagaaatcatctttgaaaattatttaagtaaaatttttttattttaatttttgtgggtacatagtaggcatatatatttatggggtacatgagatgttttggtacaggcatggaatgtgtaataatcacataatgtaaaatgggatatcttccctgaagcatttattttttgtgttaaaaacaatccagttatattatttaattttaatcaaacaatatagcactcaccatatgtcaggcactgttctaagtgctttgtgaagattaactcattgaattcgttgattcctcttgacacactttgagaaaggtactcttaatatttgtattttacagatagagaaacagaagcatagaaaaggtaaatagattggccagtgtcacagagctggtaatgatggagttgggaatcaaaacgtgttattctaagcactctaaagcacctgatgagaccagaaagaatgggggaagcagtagctaactagatggatggaaggcatcaggaagagtaaaagccagtaccttctaggaaacagccagagcttcagatagccctgggtctcagatgccttagtacagaataaaataagatccgataaatccatcctggtggtctgcatggcatttgtcagtaatctaggattcctctgtccatttaccctcctcttctttgccttggtatcatagggagcaaaacatgctttgatggacttttgctttctatattggacctcagagagctagagtgatgtgcttttgaggtcccttacctgagggagttgggggttgggggtgtctgtgttctggtcaaaaggtccttggtgaaggtctgaaaagcctggtctggaatgatctgtgggaggaactgggcccattgccccatatccttagcccacctccttcctcttcttttgcaaatggttgtattatagttggtgggtctgcccattaaccttgcctattttgaagcctgggaccttttctttgtttagggggaaggccttttgatctcctagtgtgctaggattctggggagggaagctcatgaggctggtatagtcattaagttcagctgttcactaaaaattacctttctctgaatttggaagatagcaaccatgatagtaattccctctcggcctcaaagggaaaatgaccactctagtttttgtttagcattcccctgtccttagggcacaaaaaccttgtggaagtattcggtggtacacatgaaggaacccgggctgggtgtctgtccacctttgtatttagtaaatataacggattagcgcgttttggtgggaggaaaatttgactcttcatacttaatgtgtaatgtacttgggatttattaattgattgatttgctgcttgtgttttttgggcctaccatcttttttttttttttgagatgtagtctcattctgtcacccaggctgcagtgcagtggcatgatcttggctcactgcaacctccacctcctgggttcaagtgattctcctgcctcagcctcccgaatagctgggattacaggcgtgcgccaccatgcgcggctaatttttatatttttaacagagacagggcttcaccatgttggccaggctggtctcgaactcctgaccttgtgattcgcccatctcggcctcccaaagtgctgggattacaggcataagccaccactcctagcccgggcctaccatctttttattctaccaagttatgcccctccatttgcttctggcagactttcatccagttcaagacccttttaacttatcaaaggtcacaagaagatgctcaagagggaatcaaagtgagtatgtggaatgcagggtattctgtcaaaactgttagaatatattaaaaattggaaaagccaaagcttgaaacactatgtctggtataacacattagttgcccataggaacattttgatcaagtgatggcattgatacaagggcgctgagtttgtgttgttaattcacttttaactcttcatgtatcatttttgttctagttgtaaactggaagaaatttttggagctgaaaggaactttagcaaaccttcaaaatcaacctgcttattttacataagtaggcattgaaacctaagaatggtcaagtcagttttccaaacccctgtaaagagttagatgaaaggagcagtccagttttctgggttaattttctggtgctttcgcatcctgaaaatccaatatgggccttattataaagctatagacgggtctatgagatctttctaggtaagagtgctatgtgctatttcagtaaaggaattggagacagagttatttgagatggagtaactgccaagtggtcttataatttccctccattctgtcctggtgattaatcctaaattggacttcagaattctcagttcagtgtgataaaaatgttagtaaaatctctgtacatggcagttatagaaacttgtttattacataatctttttctgacaattctgttcttaaatatctttggcttaattttcaaacaaaaaccaaaaataaaaataaatgattggtagtccttctaatacttgttctaattatactgctttttaatgatcaaaaaagtattttaacaaaacagccatatatcttaatatgccagaaccacttaaagttctacagtcgtgtttataccaggtatttttattgtgaaacatgccccaaacacatcttgagcggagctttaagtatgtcttgtctataacattggaaagagatatgaaccctcctttggttaattgaagtcaaggtgtaatgcctttgtggtttcccatgtgtttctaatcaatagttcttggcggtttccaaacgacttcccccatcccatctctctggtatgagcacttcaggaaacaaactgtattaactttggccagaatacacagagagggttgcaggaccttttagcaattttctgtggaggattctctgacctggtaggttgaatatctcctctgttagcctttgggtatacgttgtgatagatttatggtagggataaatcatttccaggatgatgaagaagttttaacatctacctcattgtgttatataaaaatatttaagtgttatggcatctgagtaaatggagatgggtgacagggagaaagggagtgaggaagagaagctcagggttctttaggccacaatggaccttgagctgtgtgtcattggctatttatttttgtgtgtctgtggctgaaatgctctccagaatagctgtaggaataacagctgttattaggagtaagtcagacagggtacttgtgtatttagaagaccttttaagcactggtagcagcctagacaagcagccggtagagatataagacaatggcccctcggttgtggttgccatagcccttagtatgttttatcacttgcttagagttttgttccaaaggcaggagccatgtggcagtgcactttcagtgcctcaagcattgtttgtatgtatagttcttgaaaattcatctcactttgtcacgtcacaagatgaatacgtactcagacttgatgtgaaatgctttcttttgatcatcagtgcagacacagtggttcgacttcattagtcagaggtggggcccagatactgatgttttttcaaagctccccagatgattctgatgggcagctgatactgagatttttttttttttgagaaacacagaagcatataaaacaacaatctgttttgcatatatgcagtacttggtatttagaaaagctgtttatagcctattcctattgtcaacttgaattaccataaggaaatatatttaaagtttagccttatcacctgtttgcattaggcagtggtctctaagaagcctaacaggtatttgtaagaaaagtaaattttaagcacaactcatccatctaaagaaatacataaaaaatcaagcatttgtggcccatactcttcctgccatgcccgttggtctctacctcatggctcacatggcatgtaatagcgagtcagtgtttttgttttacaaaatcctcttccaactcctcgtaggagaggattgtatcaacctggtttgtttctcctactctgatgttggaacggttaggagcaggaaatcattctgattaggtcccaaactagcataaaatgaaaatcagtgctagtaacccctgagtcctaaaagataacttacaggaaagagggaaaccagatgggaagtttaaaagcaggagaagttaatgctttaaaatcattgtttggctgggtgtggtggctcacacctgcaataccagcactttgggaggctgagatgggtggatcacttgaggtcaggagttcgagaccagcctggccaacatggtgaaacccagtctctactaaaaataaaaaaattagccaggcatagtgttgtgctcctgtagtcgcagctactcgagaggctgaggcaggagaatcgcttgaaccctggagacaggttgcagtgagttgagatcatgccactgcactccagcctaggcgatagagtgagactccttcttaaaaaataaataaataaaatgaaatcattttttgttgttttaatttccattattgtctttttttttcaacataacatctctcttaaaaatgagactaaaactttcaaggtaatatgtgaaatgaaaacatttcaaaagggtagaacatgggaagacaagacttcctcctcttcatgtaaattctatcccccagtattaacgtttgagataacctctatgaagcttcttataaatccttccagaatcgtgtatgcagtcaagcagggcccctgggattagatatatggattgtatttagattatagtaggaatgactccccctgggtttgtgcagtgcacatacccttggccacacgtggtcaccctatatgcagagtatactctacctttaaaacaatacaacataggattacattcagtgtactgtgctataccttgcctttttcaattaacagtatataatggaaactttgccattgtctttaaaggatattgtcacactgccaaattgccacattccccctttgtaaaaggcaacacctatttaaattaccagtggtgtatgagagtacctgtctcaacccattcttgccaactttgcattttatcaaacttgaaaaatatttgctgattggtaacatattcattccaaaaatgttttaagtgacttctgtgtgcaaggcttcttgctctatcctgcaaaacaaaagcaaatcagaaccgtgctttcttcttttctagatgtctgtggtttaatggcagtgagggacaaaaagcaagcaaaccacaatttacaattattttatgtacagatttatcatggaaacaaaggggcagctgtagtaagccattatagtttaatgtaaagtttaaaatgccatagaaatatgggttattgctctttgtgttgcctgcagtatttttcttctcatttgtaaatatattttccatttagtttcttgatgtcttctaggttagcttattgcataatttaagagcctttttccttttgctgcatcaaatatatggtagatagccaactttttaaggactctcttttaaaaaccttcctgaaatgataccattttattctttttgtaaagacccctatagaatatctagggaggttgagaagtttctagtattttgaaataagaatttatagcaaaccctgtgttttgactaattgtgttctataattctgtgatgtggctattggtcataagtcattagtgactttggatagagatagttcgagtggtggggtagaaagtgtttctagttataatatgtcatatacctcaaggtctagtctaatgtctgatgccatttttctggtctgtctagagattcatctaacactgctgcatgaaaatagttaaagcttgcatgttctcacttacaagtgggagctaaatgatgagaacacatgggagcatggtggggagcaacacacactggggcctgttgtgtgtgaggagggaggaggcaggtgggaggagggagagcatcaggaagaatagctaatggatgctgggcttaatacctgggtgatgggatgatctgtgcagcaaatcaccgtgtttacctacgtaacaaacctgcacatcctgcacatgtacccctgaacttaaaatagaagttggaaatttaaaaaagccttagaggaacaaaaaaaaaaaaaaaaaaagaaagaaaatggttaaagctgaagacagcacgcagtgtccgaccaaatgtgtccatgcagagctgtccctttctaggccggtgcccctgccttacattgtgtgtaaactcttgatccttttctagagcctagtgaagggtctagctgtgggaagtggagcatgaactggaaataacttcctgcctctagcgattcatttttcttttcagcaccatttcagcgatagaggttttactgaaatttaaagagagaaaggctaaaagcttagtatttcaatgtgccagctattgctgacttgcagtaaagaactgttgccgaattaatgtggttggtatttactgacagatcccttagatagcccacttcttttgtctttttttttttgttttcttttcccttctaagacttctgtggcatctatcttcaatttgtcttcaattttggggaaatgctctttcttttttaatttctaagtttttagaaattgatgctctcagatatgtctgaattgacacagtatgatggggatctaagacctgcttttgtgcctgggagccatgaacgttacactaagcagtcgaaatttctgtgctgtagttttcttctctgtaatatgaaggtgctgggataaataatctgacatcttgcttattcagctcaacaattctgtgcatatattgcatttacacatctatcttggatttttaaaagatgtggcataggtgatgggttgataggtgcagcaaaccaccatggcatacgtcgtttacttacgtaacaaacctgcacatcctgcacatgtacccctgaacttaaaaacaaaaaacaaaccaacaaacaaaaaaagcagtggcagcagatgtgtgctttgagcagttggttatattgaaatttttataatactggttttatcaaattatgactaattatcccttcacttgcaaaataaagtggttttcattttctatgtggaagtcaagagactgtactgtgcttgagttttggaaatgagttctcacgttagtccattttagaacttgcgaccaggctatcctttgtctcttccttgacagacagcagtgggttgccaacgtgcccttgtgtgcacactcaccttttctcttctctttattaatgttctgttataggcaaaatgaacattgtgctgaaggtgtgttaactcatttaattggagatgagtgaaatatcattttctaatggccttctgcatgccttagagcccaggcctatggggtacgttgaagacgtgaacattgtaatgcaagttaatgtttatatacctactttcacttccattcatctctttctttaaaggttgattaaagatttatttcaggccatgcacggtggctcacgcctgtaatcctagcattttgggaggccgaggtgggcggattgcctgagctcaggagttcgagaccactctgggcaacatggtgaaacctcgtctctactgaaatacaaaaaattagcggggcatggtggcacgtgcctgtagtcccagatactggggaggctgaggcacgagaattgcttgaactcgggaggtggaggttgcagtgagccaagatcatgccactgcactccagcctgggtgacagagtgagacttggtctcgaaaatatatatatatatatgtttatttcagcaaattctggaattatgccctcccctcccccctttttatttttgctgattgatgtttaaaagtggaccattaaaaaatgtaattccaagattgccttgcatctgttttgaatgattgtgttttgctttacaaggggcagaatgacttttggggccaaatgctcagctgactttttgttcgctgttttctgcagggatcttgagaataatggttctttttaaggccaattgttactttctttctcacacaaaggaaaaaagagactatctttaggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtttaccaactggttgcatgtacatggttaatccaaaaggctcagcttttcagcaaatggaaaaagattaacttctttatggatcacattatgagatgaaacacatttcattctagctgctgaaaaaatagcaacatgtttttgaaaccattgtgattttgtattgcagtcactaaaacatcaaatatatcatttttatgttaaagtgccctaatttgtgttgttacataaaacttggagtaccttgaccaaatagaagaaattaatgtgccgcgtgtctgttttaaagatgaaatctgagcccagtgtgaggctcatgcctgtaatcccagcactttgggaggctgaggcaggaagattgcttgagtccaggagttggagaccagcccgggcaacatagggagacctcatctctacaaaaaataaaaaatagacagacatggtggcacatgcgtgtagtcccagcttcttgggaggctgagctgggacaattgcttgagccagagaggtcaaggctgcagtgagctgtgatcacaccactgcactcctggtctgggcaacagagtgaaaccctatctttaaaaaaaaaaaaaaaaaaaagatttgaaaatttaaatcttgagaaggattctgaagatttttgagaaaatattttattcctctctctgttatctgtgtgtatgtgtatatacacatacaattttatgaaatgtggtttatgtgattgttttcagtatttggctaatatctatgtaaaagaaaaatgggcccacaggctgaatatgtgttttctcctcataaataggggactggtggttggttgcatttctttttttttttaacagtctcagatgattctgtcttcatttccactttgctcccattctggcattgcctgtgtggattgagcatgtgaaagcttgacatcatgattcaatcattctctgattttgcaataattcaaagcagagcggaagcattgtgaaagaatcatgccagttttcttaaggtctgatacacccatcctaatttacagtattgttctaaagatgcaccaggaaacacacatgcatgcacacacacaccctagtgagacatctgaggggatttggctgcctcccgttcctttcctgtctcctccctttgtttccagatgcatcagcagatggccgtccaaagctctaaatttgtaccttgtgtgacctttagcctggagaaaggcaaatttattctgaggatagacttccctgccattgcaagtagaccttctgtcagttgttataaataaactcaagtctttggatgttccttctgaggttgaattggcatagggggccgttaattaaactgtagcctttcttgggactctaacaaattttaaagatgagtaagacaacattggaggtactccctgatagtcctgcagtgtaggataatacaggagaagctccaggatccatctcctgagagctggctttgcagcgtaggataatacaggagaagctccaggattcatttcctgagagctggcttcaaaagaagttttcaggttgcatggcaggcattgacatggactttggagtcaggcagacccgggcttgagttctgcctctgctctatactagcagcgcttacctcatggagctgttagcattaaatgaggaggtatttatctatctgtcatttcccagaactgatccaggacctaataggcgctgaataaatggtaggccacttaattttatatcacaagagcacattcttaaatctttattcaaggacaggaggccctggaactaactaatgaaggaaagggaaattgctgtgtgccatcaagcagaggatcagaaaaagaatatgagaataattttattagcacttacaattcactgcgtttcaactattgcaaaataacagtatgcaagagtgtaggttgtcttacagaaatgatgtgctcttgtttgtggcagctcattttaggggagaagtcatctaggttaccatgtgtttgtagagcagaagacttaaaagtggacaaaggaagttggcattattctggaggatagaaaatcaacccaacttctcttctcttcccaccactggactctgggtgagcttgagaatgggaagtcttttctgttgcctagtgagtcaactcttaatgtagtctaccgtggacatcagggttggtctgaatgtaaagttgcatgcccctggacacagtgcttgggtgagagatgacagaggaacagctggacaaagtaaatggggtgagaataatggcctggaggtccttggggaaaacttgtcaccaccttaggttggctgtgactatttactaatatgagctgtgatcagaggctgagggataaagcaggccaacatttccttttcttcttattactgatttcttctagttcttcccccataattggccccaaccttctaaagaaaaggctctgcagacagcagtgggggaaaatcagtctgatgtagtctggagaaaatctttgtcctgccctgttttcctgtagctttgaaaatctcaaatgcaaggccaaacaacgaattattattaacgtgatagaggaaactggtactattaatgtcatgcaaggagaaagcccattttgagtagaaacagaaggacatttatgaggggaaagttggctgggtagggcaaaactgagtagtagaaaatttaactgtaattattccattgaatttttttagaaggactcttcaaattattgaaagttgcttagtaattagcatagtaaccatttacaaaatacactctgacctagagcaacagggaagggagtcagagagacaagttttgtgcagactgtcagctacagcaggaaagtatgcacggtgaatttccacgttaggtcaggcccatgtaaaatttacaaatggcagggggtatggaggaataaaggcattagcattgcatatgacctggtggccctttgaaaactgtgtttggggtttatgtttctagttgcagctaaatctgaatttgaggttttaatccttttgaaccaagctaggtctaagaattagacatttgatctcatgcatcttatccagcacacaaaaacttgagtgcttccttggcttggacataagctggatcccagctggcccctgattttagtttctgtgaagtgattagtgattaggtggcaccatggtaaggcagggtgctgtggtggcagggtcttccccccatgcagaagggcccctgcagaacacagcagtaagttttttaactggcctactcctgcttgccccagagggctgagaattggtttttagatagctgatttgtttgttattggctctaattaggcaggtaggcttagctcctttaattattcatgctactttgcggaagcttaagctacttattcagagttccagggccaggacttgggtgggaattctttggcagggccagctgcagaattagcattaatgtgatactaatccctgggatggcccctcagagcagtgtacccaaatgtttgtttttcacatctagagtccacaaacatgtgctcagtaatgtccagcaggctctagcactcaacatctagatggcatggtttatggccaaggagctttggagcattggtcaaagtctcaagcagagagatcagagatacagtctagaaggtattcttatatttaatctctctctggaggcattggactcatatggcctaaattttttgactcagatacctgtacatacatgtacacccctcaccttgctctcttcacacacttgtttaagggaaaatgaggccaggcatggtggctcactgctgtaatcccagcactttgggaggctgaagtgggtgggtcacttgaggccaggagtttgagacctgagtgggcaacatagcaaaactctgtctttccaaaaaatctaaagggcaaatgggacagattatgtaaaaatcattcagaaaataatttgtatgcagcaaaattaactatatttagatatcccatgttggttattatacctgggtatctttttcttctgtcacttatgcttaagatttgtcttcacgtatggtaaatacctgcataccattacttatgagatggctttccacatagttagtgggatgtacactgatattaggatattaggaagaacctcagaccaagtataaatggctgaaaaaaaaaaaagccctcacaagtgatggtgtattggtaaaagtggtaaaaagagatgagaaggtctctagagcgtctctcttgaatatagagattctagcattttaattttgttcaaggtgggattgacagatatagctagttgaattttcaggaagtaatagaaaaatagtttaacaaaccaaattgctaattatgttctcagcgaattgctgtaatattctggtgttttattgtgtgatattttataggagttagaaggatcttgactgtccctttctagaaaaaagtcagggtgcagagactttacgaggtggcccccaccacaatactaccttgacccagcctggactgctggttagagccccaaagattgttcccttcattttaggtttcctctatggtgctatagcatgtatacataaaacattgtttataccactaaaagacgtgcttagttttttttttttctccatttcattcactgaagatacctcaaatgcaaaacaccacgcggtattgcaatcccgtgcttgataagttcaggccttttccaacttcctcaccccattgctttttttatttttcttttttttttgagacagggtctggctttatcacccaggctggagtgcagtggcactatcttggctcactgcagcctccacctcccaggctcaagcctgctgactagctgggactactggtgcacactactatgcttggctattttttccaattttgtagaaatgagggtctcactatgctgcccaggttgaactcctgaactcaagcaatccgctgacctcagcctcccaaggtgctggaattacagatgtgagccatctctcctgacctacacatactaatgtaaaagttgggaactacatggtatctactataacacatctcaaaatttcagtggcctattgtgactctgacctaaaagctcagcatagatgttcttggcaggtgggttgcatatttctctctttttgtgccttactattccctggggctttggagtcctctgaatctagctggcctatgaaaaagagaggatgaaaactctccattttgccacctttgcctggaagtgacgtatatcacttcctccagtgtttctggtagtgagaaatagtctcagtaacccatctagtaattgatagaaatggcctggtaaatgtagtccttggcggaaagctcctctccagtgataagttcatagtatgaagggggaagtgggaattttggtggacaagtagacccctctgtccacgatatttatatgttccaagaatctagattgggcaatgtcttagtttgggctgaaataacaaaaataccatagacttggtggcttcaacaacacatttctcacagtcctggagagtagaagtccagcatcaaggcactggcagatctggtgtctggtgaaggtatgcttcatggtttgcagatagctgccttattgtctcctcacatggtggaaagagagaccactggtttcttcatccttttataagggcactaatcccattcataagggctttacccatatgaattaattatttcccagaggccccatctcaaaataccatcacattggagatttagagatcaccatatgaatttgtggggtggggaagagggacaaaaacattcactccatagcagatgatatggatactgtggagctagacatttgatttgctgctctgtacctgacatggagcaaatatacctcttggggtatatttcaccactggccatgcctgtttgcatagcttgttgtcaagattaattgagaaagaatgtctgatagtatactgagcagagaaacttactgtaactgcaaagcagtggtagaagaataataatgcaccccccctgcggtgaaaaagatgctctagcccagcaataatggtattgacttcatgaaaccacttctgacctgcggcagattgctggattgatttagtgctgcttttttttggaaacaagccttgattatgcctttttacagtctatcagtttgtgtgaaactgactatattttacagtctatcggtttgtgtgaaactgagagcaaccctggtgactctcatggctaggataccatggtaccttgataagaattccagattcaaacaacagaaacaaaagtgacacagtagtccccctcttgggcagtcttcaagcacatcttgaagagttatatagttggtctttgaatatcactgccttttggctgtttcttcgatttatataaaagaggccaatttgaagccattcactcagtactgtatcactcacatctgttgtaaaaggcattagaatctgtggagtgaggaaaaaacagagcctttatgaaatgtgcgcttgaaatgagagatgtttgtcttaaatttggacaggataaataagagacttacatggaaactttggaagctgttttagtgaaatttgcccttaaggtcttgtcttattccaaaatgatgaggcagaatgcccaaatgttagcatttgacatgtgaagaaaaggaaaaattggataaaaagtgaagaatatgttcaaatttctctatacaagcattagagaatataagaaggcctgttcagcattgggtttaaatagggaataattaggaaatggtgtaatgtattatttactcactgtttttctagggacagtcattccagaatcaaaatcaattggtcagcttcacctggtagctagaagtaaaagcatggcaaattcagatgccctcaagggccacgcaggtaaccttaagtgggtgatgcaggttctaaattagagtggggaatggacagatcaagtccctggaggaagagggagaaagtagatattgaagcttaatgcagaaatacaggaccagtgttgttacgtcttcagacttttaaaggagactgaaatataggtggtttttttattttttattttttgagacatatgacttttaatgtcagctcgggtgttttgaggtactgtgtaggtcagtgaaaaattgtctgctagtcttaattttcctgagagctacctgtctgtggcatctattttagtggccagggaaagcagatttgcttcttggcgcgggatggacagggagggctctttggtttagcaacatattctctgagtaaacaatcaggctacatttttgcagtcatagcgtcagggggctgatgccatttttaatcacttgtaaagctctaggggctatatggagaacctactgttacttgatactctttcataaagtaaaattttatttactttataaaaatgccataatcatcagttgccggcacttatgtttctagtacccgagattaggaaatcaacaaaaatggtttatttgggattggaaacataaccaatttaagatctctttagttacttgaaaagaaagtagaaataaaaggcattcagattcttggctggcctgtgaagtggaaggaattcagtttaattgtgtgtgtgtgtgtgtgtgtgtgtgtgtgtgtgtggcaatagctaattgtaatgcaggtttaatgtccctatctttttagtaggtttggcttttggagaaaaaagttgcttggtgtagaaaataattatgtcatatatgaaaatggtcaaaaatgaaatataatcaaggggagctgttaatagttttgcatgtctttaaaaaactgctagttttattgaaaatttatcaaacttaacctttgaaaataagacaggttattattttcaaggttcaaggtttatttttcccaagagaagacaagttttgttggatatgtgtgtgttttggttttttaatcaagccaggtttcattttcttacttttaagtaatggatatatggtaattaaataagaaaacagattaaaaagacaatttttacctaaaagatttgttgaaacctgaaagtgacctttgtaagtcaccatcttttttctgaaccttcatccataaattgggaacagtttcctctatcttgcagattgttctttagcattaaatgaatatctgtgtaatgtgcctgttgcaatacttccacgtaatagggactcattcctttctttgctctctttgatcctgaagacatcaaggagggtgctgactccccatactgatcctagctggggaaagaatatagcttgggctacttttgttttggggtcatatttaagttaatttggtctagtatgccgtgtctgtggttcttgggcatcagcatttacccgttttatgaaactctctgtaaattatagccatatagcaggtgcttagagtggtctcaccgttaatacatttttaaatcacatttgtagattctggacagaaaagtcaggaccttaaccaccagtagaaagcaggtaatgaacttgtgtgtactgccaagtgacctctctactgagaacatctaaggataagccacaaaatgagaagtggacgtgaaacccctttggatcagcctgccttaactaaatggaagaattggggctttactgcatgtttattattattttatttttggtaggcaccaggtctcgctatgttgcccaggctggtctgaaatccctggtctcaagtgatcctcttgactcagcctcccacagtgttggattagaggcgtgagccacaatgtctggcctttactgcatgttaatttggcgtttcagcagccaactcagctgggaagttgcttgcttgttgggaagacatgggcaagagaaaagtttgataaatgtgcatgctgtgactttatgcttgcaaaaaaccaaaatctcacagttgtcagtacagccataaatgctaacatctacttctgcttcttgacaaatgcattgctgataaggacaagggaaatggcccgcttgactgtgtttagggtcaggaattcttccctttgccttagaataaaaaatagtgttttcttggaatgttaagattgaaagtgtcttcaccggattcaatttctgtgacatcagttctagaagccctccttgatgtatatgggtagttcacaacagtgagtaactgtggttaaaaaacaaagaagagtaagttgttacaggtagaggcatgtagagaacacattcttattagtgccggaagtccttatccaagagtctgcatgcagaacacagaggtgaatttcattctttttctttgaagcattttcttaatcttttcacatcaaaatgagggaggacttttgtgggaatgatgaaaacactacttatgaaagattgttaagttcttatttgagtctgaaatatgactaaatcttgccagcctatcagatgcagttgaaatgggaacctctgcaaaactgtgggaatcaaagaaaaactgccttcaccttgtctttttcaaagaaggggatgtagggaaggcaagatcctcttcatgactttttggaagggtgatttctatagtcttaacaacatttgtagaccatgtaatatgtgcagagcactaaatgggtttataggtaatgaaattttagacttggagttgaccttaattgtaattttattcaacctgcttattttgaaaatgagacaattaagaggaagtttactgcctctttaggaagttaaacagctacacatctttataaatatttttgagttttatgatgtagcaagtgattgatactcacaagcacacccagcacattcaaatacagaggatctacagagcattaacaagttcgctagataatagtgatacattttctaggaagaggtgggatttgaaccaattttagtaaaaaggggaggaaagacagagtggtagtgcatgcatgtagtgctagctacttgggaggctgaggcaggaggattcttgagcccgtgagtttgaggctgcagtaggctataatcatgccactgcactccagcctgggtgacacagagcaagaccctgtcttaaaaatgggggacaggaggccaggcgtggtggttcatgcctgtaatcccagcactttgggaggctgaggcaggggaatcacctgaggtcgggagttcgagagcagcttgaccaacatggagaaaccccatctctactaaaaatacaaaattagttgggcatggtggcacgtgtctgtaatcccagctactcaggaggctgaggcagagaattgcttgaaccagggaggcggagtttgcagtgagctaagatcatgccactgcactccagcctgggcaacagagcgacactccgtctcaaaaaaaaaaattgagagagggacttggagcagtagagttaaaatagatgagaactgcaataggaaatgagaattggtggtgtgtgataatttgtgggatcagatattgagagtgggagttcctaccagtgtgtgtctgtgtgtgtttgttttttaaaataggaaatggtggctaggggagttttttgtgttaaatctgtgttgttggagagtttttggttggtgaggggggccagggtgaccagatgaggaaccgacaaaatttagacacctgagaaagaaagggaggaaatggactaacatattctcaggtagttaacctcctcagcgtcacctactggtccttctgaatgttatcagttcccttaatgagccatgcttctcacttctgtcctttttctttttttctttctttttctttttcttttttttttgagacggagttttggtcttgttgcccaggctggagtgcaatggcgcgatcttggcttactgcgacctccttctcccgggtttaagtgattctcctgcctcaacctccctagtagctgggattacaggtgcctgccaccatgcccagctaatttttgtatttttatgagagatgtttcaccatgttgtccaggctggtctgaaaagcctgacctcaggtaatccacccaccttggcctccctaagtgctgggattacaggcgtgagccaccacacctggcccacttctgtcctttttcatatgctatttcatttactgataatacctttctccgtacccccacccaaagcttgagttattgtctgttcatttgtgtgtttagactttattcacccttcattttaggatggttgtttctataatacataaaagatatctacaaatttgacctttaatgtaggaacaatgacaaaccactgaaggctttccaatcaggagagtgatgtgagcagatttatatttaaaagcagtggttcccaagctttatgttgcatcagaattgtctgaagggcttgttaaaacactaattactgggttccatgctcagtttatgattcagtaggtctgggctagagcctgagaatttgcatttctaacaagttcccaggtgcagtctgaagatcatactcatttagagggatcgctcgggccgcagcaggaatgaatgggcatttgtgggtggttgggcaggacaggagcagggcaaatgacctgaaaaatgtatcactatttcaggtaagaaataatgatggagaaaagtgagtctgtccagagatacttatagacggtagttgattagagacgagaaacgaaggaggtgaagccggggtttctggcatggggaaccagatgggtggtggtgccattcactgaaatagggagcactcaatgagcagattttctgagagaggtcaggaagcaggatagtgatgtgatggtgtgtgtggagacctgcaagtctgtcggtgcactagccttcacttcagtggggagaggcttctaccactttgggaaccatcagtttgggattgatagttaacccattggagtagatgggattagctaggaaggtaggtgagaagagcacctgggacagaatgcaaagggtcacaactcattaagggaagctagaggaagaggagaaggaattgttagagagggtcacaacaccagaagtgtacagtgctattgtggagaccaagaggaagatgtgtttagaagggaggagagtagagctgggcgtggtggctcacgcctataatcctagcactctgggaggctgaggtgggcggatcacttgaggtcaggagttcaagaccaggctaaccaacacagtgaaaccccgtctctacgaaaaatacaaaagttagccgggcgtggtggccggcatctgtaatcccaggtacttgggaagctgaggcaggagaattgcttgaacccgggaggcagaggatggagtgacccaagatcacatcattgcactccagcctcggcaacagagcgagagactccatccaaaaagaaaaaaagaaaaaaaaggagaggagagaaacagcatcagttgctgctggggaatgccaggaaattaagtactaaagagggttcagttgagttcacaacatggaagtccgtcgtgcattcacacagtgctgactcagcctgctttgggccaggctctacgctagacactgagggttcaaccatgactgagattttcttccagtggcttggaagaagcagaaggcagccagcaatgggttaggagggtcaggacagaaactgactatttaagcagtaagttccagaagactggaaggagagagggcagccgagtagagggtggggtagctgggggattttcacgatgatgatgatgatggaagagacttgagagtgtttaaatgtaataggaagattcagagggagagactgaagatttggaagggagagaaaagctggatagaggcatgtccatgggagtatgggatgggaaggagaccaccgcccagaccctgcatgggtggtctgcatgactatcccacaagaaccagcttgatatttagtctgatttgagggtgcttaaaggccccattcgggtttgcctcacttaggtgccacatagccttaatttccagcatgaaagatttattcctttggactactttcatttagagatatgcaagatattcctggggcaggcaggataacacattacagaaatagactctaacgagcaagtaaatacttagctcccctttatcctaatgggaggtagtgagcttgcgtgctcaggaggaagagactgaatcctggagtctgtcctagcctgcctagtttcagttctgatttagtggagacaaaaggccctgtatgattttaacatagttgtggcagctgtttccttgagatcagttcaataatggtattaaaatatgatagagtcgattgaatgttcagcaagcctatgggtaactcagtgtcccctgctccaccatgtgtgaggttacaaatgaggtcatatgaccatcaatattaaaatgttgccagtaattgcgcccacttagttggtaggcaggatctcagtcctcttcatgacccctcttgattctctctgagggcatcatacatggttcacaaacagttctgtcgttctcctctggcaaagccagttgggggaggtatcttgctgttggcactgtggttttccataaagatggaaagcatctgcccaggagtctccttgaatcccaagttgcagaactttcaaagagccagtttgtgctgatactattgatcctgactacatcagagtctcaattctttaaagaaatggagtcttttacactccagtctgtgtttcacctgtgtggctaacgtgggcaacagtgtcttcttcttccactgtcttccccaattctgtgatgcttttccctgtggaaactgagtcatgcagtggacacctgggaaacgcccttgagattctgccaaagtaagaatctcacttttggtgagtactcccctcctcccagaataagagaagccttgtattctgtaaattaaacttcagtttaaatgtcctagaccactattgtccaatggaacattttataatctgtgccgagtaaccactagctgctgagttagtgagtgttgaaatgtggctagtgtcactggggaactgaattttaaattttacttaattttaattactttagagtttaatagtcacaggtggttagacagtgtagctctagaccagtggtttcgaaattttatcatgcatcagaatcaactggaggacttgttaaaacatagattgctgggccctgtcctccccaaagtttctgattcagttggtctggatcaggggttgaaaatctacatttcttacaagttcccaggtgatgctgctagcctggaggaagccacatttgggaatcaccactgtagactttgttctagtatttaattaatatgctaactcacacagatagaattgccatcagccagtcgtcagggttccgggtcagctggttgacaagcagcctagtacctcccctcctttcccatccctaaaccacactggcttcttttttccaaaaacattacagctcatctttaagggtgattcatgatactttctaaacagccacagtagctgaaacattggactactggggaaattccagccttgaacagactttggttttcattccagttttactaatttgttctctaatcttacaagaaattagaccatgtgtgtggcgcatgtaggctgtgagtaattttatctttgccaagctcatacttggcattatagtcagtgatttctgtgtccatgctggctagcctgggctcagagggactgtccctaaaatcattttttaatgagtagctttttaacccaatggcaaaatcatttttaatacttacaaatacggtctaataaatattttttttagaataacagagcactgtcttatgggtgattgtttatacaaggtctttctcaaaagcatattggaatatttacagatgaaatgacatgctgtctgagattcactttaaaggcctggttgggggatggtagctgaaaccagattgcaaaatgttgatgattgttgaagtatacatggaggtgcagtatactattctttcaacttttgtgattgtttgaaattttacataataggttaaaaaaaaagcatgctcttagagaaactaaatacagcatctttgtgaagtaccaggtaaataattgacattaaaaatgaaaagtagtttgttggttttgttttagggaattcaactggataaagaatgtaatggatgatctaaaggaaatggaagagaatagcaattgtgtaaatgtaatacattatagaccattgttaaggaagaatctgcagatatgcaaaggacttcgtatgtgtgtatggtgtttaagtaggggaaatacacccctactgatttttctgtataccattatagatatctcttcttaacagttcgcaacacaactggtgctcactgtgatgtgtcaaagttttatttgatttggacaaaggcaaagattttataaatttaataaagaggcaggaaggagggaaggaagtggtaagtcataccactggagttcataggcagctaaacttttctgggtggcccagtttagatttttttagtaaagagatgatatttaccctgaaagagaagagtttaaaaaaaagagactttgtcaatcttctaaaggttgtgtgaataaactcactttttttttttttggagacaagtttcttactttgttgcccaggctgtagggtagagtggtgagataatagctcactgcagccttgatctcccaggttctagcaatcctgctgcctcagcttctccagtagtcgggattataggcatgcaccaccacacctggctaatttttaaaaagtttttacagagatgaagtctcactgtgttgcccaggccgatcttgaactcctgagctcaagccatcctcccaccttggcttcccaaagttttgggattattggtgtgagtcactgtggtcagccatcaacttatttttgatttagaaaataatctcagattttcttcagctagatggtaattgaagttgagtattttaaatttctttgacaattacaggaagcaaagaagtggttttattaaatagcagtgagcttcatgccattttacagtatgtaaccgagacccatgttttccttttgatgtagtcaatttgttaccatctttttccactttgaaatgtctctttaaatgcattttcaccccatttctatcttacatcaccttcaccccctagtgcaatccctacctccctctgcctggattactgctgctaataacttccttactggatagtcttccctcaagaagtgtcctttcccttccctttcctccagtgattttccttttctttgactgtcgtttggaccaaacgacttagcatccatttgttcttccttgtgtgtagctttttgtttgccagttacataaaaagtatgcctgtgtattaccatatgatatgacagtaggtatataacagtgctggtcttcagttgaaaatatttataaaatgtaacaagaccactagtctctttagtttttaatacttaactgtaatttgatagagaataaattttccaaaggtggcatcttcattgatgtattactcacaagcctgcaggttgaactcatggtcatagatgagtttccacatgttttctcctatacccattgaattcgtcaaaacatacctgactgtatgtgtaagggagctgcttaaagattttggcagtataggtttttgcacctagcatttgctgatttcttaaaaaaaaaaaaacacataataacagaaggctattctgtatctatttcagcactgctgagtgtttaagtatttattgcttaattttaaatttttggataaaagtattggataaaagttgcttagaagcaacttttagggagttgcttctgagagtgtgttcaaagggtacctttgactcttgttggagtttgagtaatgttcaaacaagagtaacataaaataatcctccagtgatctgaaattgttaattgtcgggataagcatagactgtcctcttagttcaaaccaacagactgaggaacttgttcataaaactctcttctttgacttggaaagacagattaaatgtggagtaaaactcctcggggttttctcttttttggactgtcagtatggcataaaaggaaaccttctgtaaattgaatactatctgaaaccagatgcactcatcaaagcatttgttgaactcctatgcattaggctctgtaattctcgtgaagccttgcaccattttcagcattgaatttaaaagtaggtcagtgaccacagtgaggtaagaaaaacattttttgcaaaaagaaaatccttggagagtgctgctttgataagacgtttaagctttccctcagatagctgattacatgcgtgtgtccggatttcctacatctctcatgctcttgtcccttgaagagtctctgaaatacagaactgtttagtgcttttaagccatgcactttgtgtttgtcgagaagaaaccaaaagacctgtgcctggcaaagccatgttgaagcctctaatgtctaattgtctgttggttaagatggcactcagtagtcaagacccaaaacactgaactcaccaagcaagcacaacagaaggggtgttcaatatttctctttttgtaaatgcttttgtgcctcttagttgctagaaaggactagatgatgtctgttttaggcacacttcttccttctttctccctctggtttctctctctttagtttctctttccggaactatgggatttttgttgcatgatagcctcttagatgtgtgatcttcatgcttaatatgcagtgatatgcagggaacagattctgggactacttttttcctttttttctctgctcataggccttggtgtatgagattccttttcaggatttttctaccatctaatggatttctgcaaaattaattaacagtgtaaagtttctcaaatttttttcctgacctctccccttaaaatagtctgtagttttatggcaggacttggggggctctcatccttgcagggaagcaccggtcaaggttctcatggtaagtgcctctttgagaggtttaaaattacatgcttttagcttccagagaggagggaaaaccttccctttaggtccgtatcatttgagaggaaacttggggttgaataggctaaatgttcctacttgtggccttgttttcactgcttggttacctagtgcaaacagattaatgtaagagttacggctttttagaatacagacagtcgtcaaaaaaatccaaagactttagaaaatggaatttgcttgtagaagaagcttctcagatactggtgtcaaacagctttgctaaagcattaatgtggctacatgtttgacagactgcataaccttcctacattttcccagagtagtctaatgagttatcaccacctttatacattccatcctacatagaaacctttcctcattcaaacagatttcaaggaaaaaggtcataccctattccaaatctacctgttgcctcttctatactctcttccacttttaagtcctctgtaacaacggctccttctgtcaccgacatagaaatattccagtttttgaaataggcccgcaaggagtttcaatcactgagagcttggggaataaaaactaattttaatatttgcattaaaaaaacaattagacaaatatattgcagaaaattatacacatttctaaaccaaatgcataaagcctgtattaatcagaacttgtagttaagccttgtttttttctttgctttacattaataagaaagaggcaagacacaagaaaaactgaaggatttaacaaatcaacaacagtttcccttctgattaacataacgaagtgaggacagagccagctcagttctctccttttgcagtgttccgtggagcgtggagacaacagtaccttcaggtactaaaggcttttcatgttttgtagttacagcagttagaaatttagtaagacatttcagtgttatacttaaagatgaaaactaaaaagcttttctgattttaattagattgtttattcgaaaaaccattcattctcctaaaatttttgtttaaaaaaagattggctcatcttcattatccagactgctgcatataccatgcacagccagaagttgccatagttagaggggccaggagcagagccatcctcagctcctccctactcctcccttctcacttaagtcagccccatgtggcatctcctcctgctgtctgacctcccatcgcagtctcctctgcctgacttcactgtctcctgcccaagctctcacaaaagctcatagcctcttacctgtccactcgttccttaaaatcattgacggttgtcatctttacaaacaggacaagatcatgaggtgatgtccctgctccatgtgtccattacccatggcggtggattttgaaggttcttctgggatgtggcaggtcgctgggtctccaggtcatgcccttaccccatcctcagttggcacagctctacttttgttctgccttctacgcttggagtaagattttgttgaataaaacattccaggttgtagaaaagtttgaaaaccatgggaggagataactgctaaaatgctgtgtctttccctgtattctgttggaggtgctaactttgaactcttggacttcagtttttttttgttgttgttgagatggagtctcgctctgttgcccaggctggagtgtggtggcaccatcttggttcactgcaacctgctcctcccaggttcaagcgattcttctgcctcagcctcccaagtagctgggactacaggtgtgtgccactatgcccggctaattttttgtatctttagtagatacggggtttcaccatgttggccaggctggtctcgaactcctgacctcgtgatctgcccacctcggcctcccaaagtgctgggattacaggcatgagctactgcaccctgcctgtgttcacatttctgacacttcttcagcttgaggggtccatgctaattggatccttattgtgaccagtgtttttatgcatactaatttgtttaatctgtacctgattgacataggtactaatatcagcaccgttttatggatgaggagactgaggcacagagataaaccaccttgcccagggttctatagtcagtcagtggccaagttaggattcagaggttggaggtcagcccgcttgctccggagtccacactctgaaacactagactctcgaaacaaactgaatacattaacataattaggtggcttttccagacttttgagtggaagaagtacagccactggattcctctttctacagacttcagtttcgattgtgggctgaatgtgccctcacattttgataagcctaggcctgtgtggggtaagtttggagggaaaagaattagagcaggagagaatacactgtagagaaaagagaggaaagaggtcattttccccaaacccgaaagaacccaggcccgtgggctccctggccttgatctgaagtctgggagccattgatttgtatgcccatttcatttctcatgccaggacaatgccacagtcactttgacctaattgtatggctcccctgttcccttcactcttttcatcaaagtgaatacatttgttgctttggcaactcgaggtgttagaatcttttttctttccccatccccgaaagacagttgagggacttgctccccgaaagacagttgagggacttgcgtgatagattgtgaagaaaaatctgggaatcatttaaattagattttcaggaatatgacttatctaactctgagaagctgggcagaaggcagcctcctcgcctgttgactccttcctgcctctgctagcatttcagaacaacagaagcttgcctggatcttttctcacacgagttttggtcctggagtcgccattggaagtctagtcagggttgtcaccttactgttgtaggcagaaaccactacgcagtgggttgaaggagcagaaacttcttggcaaaggcgaatcaatgtgggttggtaggaatttgcactcctcccccccctagttttcttaaaaacactcttgtaatgggacaaatgtgactgctcagaagttaccacaggggccttttggaatattttcatattcccccatctgtgggaagtgaggggctattaagtatgtgtgtgtgttggtggggagcagtaaccgagcaactcctttgctggtgggaggggatgccatgggccaagggattcctttgcatacctttgtcgagggcccgatggggagggctgtcgatggggagggctgtcgtaccaggtgagatgcaattagccatggaagcagcagtgtttggatctccagctctcagtccaagtataaaccagagttaagcctcagtgtggtgctggattagaaaggaaatatggctgaatggccgggcgcggtggcttatgcctgtaatcccagcactttgggaggccaaggtgggtggatcacgaggtcaggagttccagaccagcctggccaacatggtgaaaccctgtctctactaaaaatacaaaaattagctgggcgtggtggtcagcacctgtaaccccagctactcgggaagctgaggcaggagaatcacttgaaccctggaggcagaggttgcagcaagccaagatcgcaccagtacactccagccagggtgacagagcaagactctgtcttggcgtcagggggtgggggtgggggtggggattacagaaagaaagaaaatacggctgaatgaaaggtcaggagtggattctgggccctgactgacccagtgtgattcacagactccttcattaggagcagtctgctcagaaataccctttgcgtatatatttaaaagagctttctgtgtcatgtttgaactgtgacttattggggattattaacacttggtggggaagggagggaacaaagaatcctcagcccttcatcttagaggaggggacgatccagtttgtggattgccaggacgcttgttttgtccccttcctcccctgctgcccagccttctggctgtattactgcttatttgcctctttgttagagggagaaacaaaaggagttcagattcaatgcctgcttttgtttttgggttagcagctttggttgaagtttagctgaatgagagaggagagggaaaggtaaagactgagctatctgttaaggttattgactaatttagattgtatgccattctgtcccttgcatgctgtctgcgagggcacagccattataagcagagagtgaaaagggagattgtgtataacagaaagccaaggcgttagagcctaattggaaacaatacatgccccaaatgtgctctcgtgtcctagccaagaacatggtttcaaaaacatgagaaataaggataatgaaatgaaaaacactttagaaagcttagatacctcaggtattgtattgtgggggaaatgaaaaattaagtattagatttatatgttttctggctgggcgcagtagctcacgcctataaccccagcacttcgggaggctgaggtgggtggatcacttgagggtcaggagttcgagaccagcctggccaacatggtgaaaccctgtctctgctaaaaatacaaaaaaatttagctgggcatggtggcagatgcctgtaatctcagctacttgggaggctgacacaggagaatcacttgaatttgggaggcagcggttgaagtgagccaatagcataccactgcattccagcctgggccacagagcaagactctgtctcaaataaagaaaaaaagtgggttttttctttgcagttgggaaaagaatatgaaataaagtggcaaatatggctcatttgattattttcttaatctttattttttctcttgtattaaatttaagactgtagacttcccactagatcttggagacactaaggtgaaaatcttcacacattaagttgaaaatatctcttttgggtgggtgtaatgtttcacttgtgaaagaactgttaaaatcctgctggatcacgggtagcatagggtgcaaaggcacagaaaaagctcatttttactgaaggagttttagagcctatgtcaggtgacaaactttgtctatttctgccaccttcctggagtatttgctccattgttggcttgctgtgaaggaatgtgggcagaaagggatgctgggagctcttcattaagatcaaggcctagttcttcaaggactactgaatgattggacctttcatcagcatacaagaggaagggattgagagtgtctgttcatgccattgatttaattggtcagagaaagggccaaagaaggggcaataacctcagagaagagcactgactgcctgtagctgttcttactctgattctcagggcattcctggaggagctccagatactgaggggaagcttgcatcagtgctgcgtcagggtgggaaaagcccatcctgataccttactttgaagtagacatgtcattgagagggtccccaggcctttgtgaggagtcctggatggaggaagaaactatgccacacagaagtcctggggatgttcaaagctggcctcagaggttttcttttcaaatgagcatccctggaactgggagacagctctttcctacagaagctgagaaggggaggtcaggcagggagggcaaggggaacaccagcaccagaaggcagacagaaaagaaaaaaatgaagcagatgggaagtacacttggaaagggtgggaacagggtaggggctggctacttaaaaggcaagaggatcaaggcctcgaggagaaaaagcaaataaagaaggaaatggaatcaaatcagatgaagtccttttaggggaaggatgatgtgaacgaaacaaacaaatcaacagaatgaggaaaggcacgggtgaaaccaccagaggaaagttccagccagcacacaggagggaggaaagctcttgtttgaaatggaagctgatgctctaaaggagcattcagggtttggagcaacatttagatatgggggccactgaagcttccatttgtttactgagcacctaccacaggctgggtgctgtactaagacttaacaaaataaagatgaatacaacacagttcttcatgggactcataatggatgacaaacataagcaggtagcttttaaacattaccataattgtagtgatatggatatatatttcatgtcatatcatatttttcttttgttttttgagaatgagccttgttctgtcaccccgcctagagtgtagtggtgtgatcatagctcactgcaaccttgacctcctgggcccgagtgatcctcccacctcagccccctgagtagctgagaccagaggcaggtgccaccacacttggcttattttttaaatttttgtagagacggggtctcactacgttgcccagtgtggtcttttaactcctagcctcaattgatcctcccacctcggcctcccgaagtgttgggattacaggcatgagctgctgcacctggcttcatatttttcttcattggatgatgcccacaaagtttcagtgcaatgtatgtcttgactaatgcatttgaatataaaggtagaacattagataaatgctagaagggaaggtttgagtcagaaattttgtcctttctctaagctccctaaaggtgtaaatttatttgacaagctcttattttgatcaaattttctttccaactatcctctcactagaaagaggaagaagactttgtgttaactcaattttttagaattgtggatttggtagatgaggttgaaaaggtaaataagtgatcaccttgatctcttacctgttttagtgagtcagaagcaagaagagtgctagaatgttgattgattgttttgtggagacagggtttcgccatgttgcctaggctggtcttgaattcctgacctcaagcggtcttcctgccttggcctcccaaagtgctgggaatataggcatgagtcactgtgcccaagaatgttgaatttaacacattgtctgaaaactagatgagtggcttcttgcttctgaagaatgtgatgtgctgcttgattcaagaccgatttataatatgcccttcagtttactcttctttgttacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagctactcaggaggctgaggcaggagaatcgcttgaacttgggaggtggaggttgcagtgagccaagattgcgccactacactccagcctgatgacagagtgagactccctttcaaaaaaaaaaaaaaaaaaattgctacaaaggaatcccctttgggggagtttcatgattaaaatatttttgagtgacactatacttgctaccaattctggttatgataatgtgtagcttttagtgcccgaagaatggagttgactgttaaacagtctggtaaatattggaaataaattagagttgtggacaagaagtaaagaaagttatcagagttggataaggaatttggagagctcagagggagatggtaaaaaaaaaaaaaagttgagaaattaagatttgtttgttagtttattgaatgtctactatggtaggatctagcaaaataaagatgaatacaacacttctccatggaactcagaatggggtgactaacatgaacaagtggcttttaaacattcccatcattgtggtgatatggatttgctctaagacttcccttgtttttcaagataagtgaggctgggagagaagtctttgaagctgatgttagatgaagatgtgctaactagactggtgcctaactatcccttcttcacacctgtgactttaagtctccaaagtagtgacacttaccacacagacttcagggtccacattcaacttaagaaatctctctcaactctttgtggtgggtggatgtggatctgagatcacagtgtatagcagagaagtcctttgtaagaaaaaaatgaccaaaagatgtatgttttctattgctactggaacaaattaccacacatttaatggcatgaaataacacagatttatcattttatagttctggcagtcagaagtccaacatgggtcccactgggctaaaaccaaggtgttggcagggctgtgttccttctggagggctctaggggacaatctgtttcctggctatttccagcttttagaagccaccaccttctttggcttgtggcccccttcctccatattcaatgcaaataatgtcagggcaagaccttctcatgcttgcatgtccccagttttttggctacaacctcagaaggttctccatctatgaggattcatgtgattagattgggcccacccagataatccaggataatctcactttcacaaggtctttaactttaatcatatctgcaaagtctcctttgccatgtatggtaacatattcataggttctggggattgggatgggtatatctttagggaccattattctgcctatcaaagaaggggggcttggccctttctgtagtgcctgtggctctctaacccagttgaatgggcctctatattagttttccttcagatttctatacctgtaccataattgctagacagccccatttgatatattattccctgactcagaaatactccttggcttggcactcagagaactccatagtggggtccttaccccttcttatcttagtccggagcaataactctgttctggttggatgtgtttactcactgttgcccttcattccctgttctgttgactgcacatttctgactccctgcctgggtcattccttccaaaccagaatgtgcccttcccttatttctgcccattctttctatgaaatcctgcgacattggccatcctcactccacatttggagtttatcataattacctagtactgttatttaactttcacaagaatgcatttgctctttccatctataccaccatcctaaaatacttggtaaagtcagtcttgggatttaccctcagagacactgattacatgttctggtatggggtcaagaagtttggcatgaaacggcctctgtgggtgatgctggtataggtggccccacgtgatgctgtgcgggaaactccttgagggaggataattgacctttcacccagagtgataggcatcatgctttacatgtaggtggaggttattatatttctgggaaacgataccagttttctgaaggcaagttttaatgaagagagtgtgtcttgtgggaagtgtgtaatagagttaagggcaccaaactgtgcaccatcgttttggaaccaactgctgagtgtgaaaattcaaaggtgtacagagagtcagtctatgtcccagagtggacatggtaagacagtacagttgagaattggtaataaccattgtaatggcaaaatcaccaaacctctagattttttttgtttactttttctgtgtttcagggactttatgcagattatcaaaagcagaaattttgtcatggaaaagatttgaaaaaatggaagatggccaatttttgagaacatatggagagaactctctgctttcagtgctcattgtgataactagttcttcttgatgactggaatgcaaagaacacccaaagatctgaattcgcactgaaccaagcatttttggaatgaggtctttcatgaatatgccatgattttgatttctgcttttgttaagactgcaatggagcctttgttattttcttgattccctgaagagttctagattccctgaagagttgagtctaagtgattgatttatatacaaaattgattttgcctttttacgttattttgggatcttatagcataaaataaaacttactaataggcatattaagcaaaatgttttttgtttctttcaattttgtgccttttattacttttcctatcaactttatagacgttgaaagggaagacatctgttttcattgagagaagatcttttaaaaaacgagctatttcagagttcctattataatagggttctacctattgtaaataaaagaagttaatctgggccagatgaggtattaaaaataacagataactatgtgaatacactaaaatctattgagttgcatactttaaatgggtgctttgtatggtatgtgaaatatatctcaacaaagctgcaaaagaaaaaatacataaataggtaaaatggaaaagaaaaaaaccccagatgtttctgtgagctcttggaagctgtcacagtggtgagacacttgttttagaaatcaccaaaattttcgtttgagtccctagtcaccaaataaacataggaaattttttcatattatcttttgttgaaagaagagctattttaagataaatcatgctaggcactttaataacagtgtttgagtcaatttaagtcagttctctatttaactattaaatataaatattctgtgaatcaagtaggctgtgaaaatttatgtccttttcgcagtgggctcatttatatacgtagtgggcatattatgttcatttggtggtctgatgatacctgattgaaataacccaaatgggaccaatagggacaaagaatagcatgttctatccatgtagaactaaattgaaatattggtaattaatgtgtttatttggtttcatatgtttgaatttgtttttagcagccattatatggtactgtgtcctgccagataaaagactgaagaaagttatcatccaagttcttaccgtatgccttgcttctggatgaaaactgatttgtcacaaagctcagttaaaattcactacagtgtaattttaacaaacttgagagtggtcaaagtattttggccttgtaatgaattgagccagtatttgttgaatatctttctttcccacaactgccctcttcatagagcaggggtccccaacccccgggccacggacctgttaggaaccaggccgcacaaggggcaagtgagcaaagctttgtttgtgtttacagtgctccccatcacttgcattactgcttgagccctgcctcctgtcagatcagcagcagcattagattctcataggagtgtgaatcctattgtgaactgcacgtgtgagggatctaggttatatgctccttgtgagaatccaatgcctgatgatctgttaccgtctcccatcacccctggatgggactgtctagttgcaggaacacaagctcagggctcccattgattctacattatagtgaattgtataattatttcgttatatattacaatgtaataataatagaaataaagcacacaatgaatgtaatgtacttgaatcatccccaaaccatctcccccttgcctccccactacctggtccatggaaaaatgatcttccacgaaaccggtccctggttcctggtaccagaaaggttgggggctgctgctgtagaggataagaaaagagtaatatgacctctgccttcaaagaattgataatttggaacagagctgaacaatagaaatatgtgaaccatatgatgaactttaaatttcccagtagccacgttaggagataagaaagaaacagttcacctggttagatagatggtgaagaaaatgagaaaagaacagatttcggaattatttttaatgtattttatttaacccagtatattaaaatatcattccaacatgtaatcaatataaagattactagtgagatattttacttttttttaaacatatgaagtctttgagatctggtgtatgatttactcctaatgcacatctcaatttgatgttgaatttttgttggaaatatttgatctgtatttagattataaaatttagagtcaaaaaagtagattcacataccacatttgttccagttatacttaaaagtttttcaataactgagtcaaacatgttttaaaatctgaattaaaaattaatttaaattaatattaaaaattcaattctttcttcaccctaaacatatttcaaatgccaatagccttgtgcagctggcagctactgtatttaacagcacagatatggatgttgagagaagacttttctacctttaatacttaaataatcaaggtgatatgtaattacaaaaagaattttgttcttcttttgtataggatggttttgtgctacagactagctagagcttcactgtctaatagaactttctgtgatgaaaatgtgcaatgttggcacagtccagtccagtaaaggtagtcactagccctacatagctttttttctttttaatttttttgagacaagatctctctttgttgcccagcgtggagtgtgatgtgcaatcactgctcactgcagcctcaacttccaagtctcaagcaatcctcccacctcagtctcccaagtaactgggactagaggtgtgtaccatcgtgccctgctaatttttaaattttttgtagagataggattttgcttaagtaatcctcctgcctcaacctcccaaagtgttgggattacatgtgggagcccttgggcctggccacctacgtagcttttgaagacttgaaatgtggcaagtacaactaggaactgaattttaatcttgtttatttcaagtgtgagtagctacatagggctagtggctgtcgtactcaactagagactcataaaggagccacaatttgaattagtttaggcagtgagaaaatgattaagacattaggagaatagcttagaccagtggttttcaaacattactgcacactggaattatagggggatttttaaaaaaacctctgattgtctgccactcccacacattctggtttaattgatggagatgacctagtcattcggagtttacaaagctccccaggtgattgtgatgtataacaaatttgggaacagatctatgcttgtattataaattctccacaaatctatttccttgctattcatattatatgtaagtttgctaggaacaagaacaaataaagaaggaaccacatcaataccttgtgtttgctagattcctaagactactacatatatactcttaattgatcataccctgtgcattagatggggtagaaatgatcccacttggctaacaaaaagagattcaaaggttagttgacttgctgaaggtcacatagctggggggtgatggagtcctgtcttaaacctggatctcatgtttctgccaccacataagcagagaaatgtagcgtatccagcttcctccaattcgtggcttgttttctctctcttcataatagagcccttgtgcttggatttataaagaatgtttcttttgatatttagggggaaaaaatctcattaacaattggatgtttgtagtccaacagattcgttatcctctaaggggcactgtgttgggtgttagcagttctctgctctcttcctggtacaacatatgatcttggtgaccttgggttagccagttagcacgtcggatttctagttgttagaagaggagttatcaaacctgtttgttctatctcttaaaggattgttgtcaaaaaatatcattgctttgtaatggagaccaacatttatacttctgcagttatacttgctcctgaaataaatttttttcttacctttttgaaataatagtttttaaaattgagccattttcatatgttagacatgaattaattcaaccctcacaacagccctgggagatagggcctattacccttctcttggtgatgaagaaatcaaggttcagtgacttgctgaaggtcacacatcttattagagacagagctgggattagaaccaaggtggttttgcttcaaagcctatggtattatctgctccagagaactaaatcatacccttgtggcctgagtgcaatttgcctttaataggatgtttactgccttctgcattactggtaccaaggggtggcaagatttcactagtgactttgaagttcccctcttagacttgtaatagatggtggatatttcctcagtcttagataaaataaaagcatcttcagaaaatattgctactcatgtgtctcaaatttaggagcagtgagcttgccatgcaaaggtagctttcagaccatcccctttccctctcccctagtttttctaataggtatcctagagctcccggtactactcagccaggatttaatttgaaatgagttagtttataatgaattgaatgttgtttttttttctccctggcttttcccatttggagaaaaacacttcaaacctagaacaggtatctgctttgtttgatggttaattttctttcttcctttgtgtgtgtgtatgtgtgtgttttgagatggagtctcgctctatcacccaagctggagtgcaatggtgcagtcttggctcactgcaacctctgactcgcaggttcaagcgattctcctgcctcagtctcctgagtagctgggtttacaggcatatgcaacgatgcctggctaattttttattttttttggtatttttagtagagacagggtttcaccacgttgaccaatctggtcttgaactcctgacctcaggtgatccgccgaccttggcctcccaaagtgctgggattacaggtgtgagcccccgcactcagccactgatggttaattttcaaatgtatcttcctcctctgcttttctgtgggtgccaacaaatagaatggtgggtttgtttgttattcttaactcctttggctggctttaaacatgttctctttttagccttatttttctaaaagcttagtgcagaaatttcttgtttggcttccactcttcagggtgtgataattcccaaggtctctctctagctcctcaggaatgtacccccctgatggactgaaatttgtccactccagtgaaattgtttgggggagaagggagcagagtacacgttcaagatgttttctcccagcatttgtctgttgatgagcttttgtaatttccatttcactgtccttgccccagaggataaccttggatctcagtgtagactagattgagtgtaaaatgagttagcacaaatgaagtggaaacagatcagcgtgtgaggaggaggctcagacgctaaatcctctagttgggtaaagttgaaagcattttcctcagagcctccctgggaatgcttgtcctatttctcagagaaataagctactgtgtgcatgttgttgctgttgatgcctttgacatttgtgcttagcgaagtggagggttctgtgggggataccaaaaaattgccctaatctctgtcctcaggaatcttattgagaaggggagatgacctgattgctagacatccatctagcttccctctgctaggcacgagatgtacaaaggtttaaaaagagccatgaatgctaacttcttggcttacagcttagcagggaactcagccatgacttgtaatacagtgggatcagtactaccatggcagcatcaacaagaaacaagtgcgatctcatagccctgcgcaagtagtgaactaccagcaaagtcggagaggcttcatagagaaggggagttgagcagagttctgaaaagactcccctctgactagtgggacagggcattcgtgcaggcaagaacaccctgtgcgaaggcactgaggtgtgaagcagcctggtgtgttggtgagtgctccacaagagccatgtcagacctcaattcagtgctattttgtgtgttgcaggcaggaggttcaaaggagcccgagagcaggaaggctgaccaagccagatttggaaatacttggctgggatgttcctggtcagtgggctatttgggcaaagtggttaaagtgggacaaaggcacagggaaggaatccatggagggaaggggagaaatggctcctttagtatcttgaatgaggcttttggatgtgagtccaggtacagtgctatagtttaattgcttttgcttctgtttctttaaggatacattgcacttaaaccccagtaattattccagattttgttagtggatatatccccaccccccatctggctcaagctaagcagttggcataagtaggggaacagaaggctcagaattgtccactggaagtactcggcttttctttggagagatcaggtttcttccatgggaaaatgatgtcaacacacttatcttagcactttgcctcgagggcacctgtgggcttgcgcctagagcaaaggaaaggggttccctaaaacttcctttctgttttgggaacatggagatgtgatagaatatccctgataaaagcatcagtttatggtggaggtgagagtttatgaccaggaccagaaagttgctagaaaggttgctaagtggagaattatggttggttattttcaggaagcaacttaatgttgtgggaagaagcactggactaggatttgggaaatttgaggtctaatcttgattttaccttaactaataagatgatcttgatctttctgagccatggtttcctaacaggcaaataaggagactggttaggagactcaagagagcatatagcaggtgtggtaaaccatgcagcactttatagtgtgaggactgtctgaaccctgtcacttggcgcctccatccggacaccacgtgtgccctcctgcccgctgcgggggaggacatgcccctgatgggtctgggctgcactggcctctgggtgactcattggcgttttgtaaaccaccttatctttgaagaaaatgttttccactactagtaaaatttctttcttttctgtctttatttgtttctctttaaagttttcttaaactgagctaacttcaaagaagtatctggaattctcttcttcctccttaaccacttatagcccccttatccccagtcatcattgtagtatatctaattgttggtggatataatgtgggccactttggatttgagtagtcaaaatcagagcctggctagtaattgggtttgaaggagagttgagctgaagtcatctcatgaaacaaaaatggcaaaagaccatcctattaacactggacttcctttgtcttccttcataagatccctcaggctttccttagtattaaggagcagggggagaagacggtggcatatactgccctttaaatatggcatttctgaacttagctctccttgtactttatcaagtgagttgtcttcctctctcaactagatccaaagaaacatggcagcctctgcagtccccgtgaagtgctgtgagtgggatgccagcaataaaatcatgtctttctatggatttttggttggtgttctaaggcttgccgcttctcttcctaataagcctgcaccgattttgtccctgaagatttgaggctgtgaaatattcttccttcttcctgcctcctccagtctgggaagcttcacttatagccagagggctgagtgaggtacagctactcctacaatgaggcaagccttagtgttcttggcttgcttcactgtgtttctgacactgccttaccttaactcttgagtaagccccgtttcctgggcagaatctcacttctcctttcttgctggtcatttggctcttttttttctgacaagagctggatcttgcttgtttaccatctaccccagcaccttattcttttttcttggaagtgccaacatattcctctacgtgctgaacctgttcagtaattcttgttggattgtcattcctttggcaaactgaaatgaaacacacaaatctcaaaatagatgtaaccagactcctcaaacttaataaataccgtatgtgcttacactaggaatcttgcttgtcccgtttgttaacgggtacttcaccccactctcctgcctcctgcttcttccctcggcccctgtttcctacaaatcgaaggctgacagagcttttcccctgtgaatgctgctgactttaccagcagctcatcctgtgtagttacgctgcatcttttgatgccgtgcactcgtttggatagtatatgctgtttaaggaactgtctgtgcttgtattattttgtttgtggaggatgtaaatgatatagggttaattctgattgccatcttcatagtgagctcgctgtggactttatcagtatgtacacagcatatgcatgtgtgcacacaataggttttgccatggagtgcttctttcttccgagagcaggcctggtcaactgttgatgcaagcaacaacatttgtttattgagttcttaatctgccaggcactgtgctaagctatgtgtgttttagctcatttaattgtcaaaataacttggttaggtaggtactgttgtcatcatcaccccattttaggaggacctgaagcatggagttgttaagctacttgcaagtgatcagaagatctggattttcaagctgggcagttggcctccagagctcaggctcttacccatttctaaatcactgctcctaagttgctaaggcaaatgattgaaccaggaattggtttagcccctgaatgacaaagcatagagtagtcatggcttcagtgtagcactgatacctttatttgagggattctgaagaattctgactttattacagcccttgaggcctttgattaagaaactaattcccctgatacataatgagatttctctcttgtttcctcaaaagtgagtgtgtatagatctagggctgtgccgtccgatacaggaaccaccagcctttgaggttgtggagcacttgaaatgtggctagtgtaacctaggagcaaacagtttaagtttatttcagttcaattaatttacatttaaaaacacttcagttactggaaaactttttctgtatttggaacaacttgggtatgtgaacctgtttttttttcatttgtatattttatgaaatctaaacataagtgtatctgctgaaaatttagcatgtgaattacaatgtgctgtaagtaaaaatacacaagatttcaaaagcttattttgcattttttcccctacttcattaataattttatgttggttacatattgaaatgatataccttatttaagccagtatatccaaaacattattgaaatcagtttcttctttttactttttaatgtagctactagaaaatttaattccatatgtgcttctcattttaattcttttagacaatgctgttttagagcatagatgtgaatactcccctgtacaacaataccttactgaagcaagtgctcaaaagataattattgaataggtgatttgagggtgggagctggctagagaactcattcaatggggagagataatggaacctgattactttgttgaaattggtactttaggatataaatgaagtaataatgatgcataatagactccacataacatacacaatgctttatagccctttctgtaaattacctctttgactcacaacgtgataaaatgaaagtggagaaaattaacatgagccaattactcttgttcagattgagtttcctgtttctgccatgagctggaatacactgacgctgttgattcgtttttcttccttttgggtggattttgcaattaagcatatgaagccctccaggacaggcctcctcctggcttcttttgccttcttgtctgctgctcaccacttcccttgtcatctgagaacctttgcatacgtgtcatttcagctcttcctgatatcatgtgtaacaccgaggaggaagtcagtgcctctggaatcagaattaagtctctgcattgccttgggacaccccatgccttgagaagtgacacagctattgtcaacacctctcattatccacctacttctgactacttttctctagcctccttggctagtatcccttttcccacatgctccctaaatgtttgtttgcacccacagctgcacccgtcttctgactcatgccatttctttgttattctgcatgttgcctgagccttcctattcactctcaggacttctgctcccccttgcgtggcctgtccagtggttgtcaaattggggtggaaatgctgaacctcctgtgtccttatgctccgcttggagaggtcatcaattgaaaattctttgcttaattgagcatgcaattaagagtaaggaaatacatgttctgatctttttcttctgctatgttttctggttataatttttttaaaaagaaaataatgtctccgtcctttagttttcccaccttgtaaaatgggagcagtatgtgcatcctaaggctagtctgaagaagcattatgccgtcatagagaaacacagtaattctatggtgtgccgtatttggctgtatactgcattttagagtagttaactaccattggatttgaaatagtacatgaaactgaaacactgcatttattaatgagggtaatttattcctaggaaacctttttaaaaatgaatgtctcctttaagtgtttgttggtttcccctttcctgaccataccctccctgctttgtgtctgtgttatttcttttaaaatttcaaatagatttgaataacttagcttaaaagatagcctctcccctccctaataaaggacaaaggtggctattttagaggtgggtgatatttgaggctgaataatgcaatgtttacggcatacacaggaagtgggaagacctgggttctggttccatttctgccttttcaatcattttgtgagctgagcaagtcccgtaatctcaggtgatgtgtatgtcccttagcacagggcctgttctctagtaattgctcaataaatattaaccattattattggttgtcttctgagaatatcacttgaagatttagatgaaagtatttggaagattgctgtctacgatttgtcaaccgtggctgacaactaggacgtgggaaagtagagaagaagctgataaagatgaaaagctcatctatagaaagatattgaaaatttatttcttctagattacaaaatgacattagatattataccctatgagaaaaaatacgcttaatcaacccattttcctcttatggccataattagtacatagtcgcatcaataaagattgacaatatagccttctcatattgccacttctagatccacttgtaggcttaattttggatcatatgccggatttgaattgtattatggaatcacagagattgtcatggtgatatgcagttccaggaaggagtgaatcgtatgttctggttattacatgaatgagagacctaagagctcagttagccaatttaacatctagtcaaaggtactgtggctaagggattaaatatggttctcatttgaaagtgggagcagagcaggaactttgtagttgtgtgttcttttaataaaggctattaatttagttttttaaaaaagaattggcctcctaccaccagctaactgtcattgctgttcatttctgttagtatgaccaagccctgttctgtggaagtgttacagaatgtttggcttcacataagagacctccctttcatgtctaaagaggcaaggaatgtaattttaggttgtttggaagatctaattttcaaagctgtgtgatttaaagaaaaaaaaaaaaagcagaaaagtcccgtacgctgtcgtttgcttagtcttatctgaggtgcccttacattttgctctttgtaccgtttgaacagccaaggaatattagtttaactcctaggtaatttgggaccacgttttgtcttttggaaaatgcagttacaaatcagttttttacaaaacaaagtgaggctgttcagcccttcattttgatcctctgaggagtgaggctgtttagattgagcaagtaagatgtatttattcttgacaaagaaagccaaattatttaccagaaagctcttttagtttcctgtacctagcacttgactgcagggtgccttaaaaaagcaagggaccaaaaataagcaaaagaatgagctctcagtatagtccacgtgggggtgggcgtccggcgcctggttctgtagcagccccactccagaactggagccaacatttgtttccttgtggttacatttagaaacttttaaccttggcttctcacactccctgaactttataaataggaacctcttcatatactagatggcttggaggcctgttacgagttcgtttgaggttctggatgatggtgatgtttgggaaatggtgatgtttgctaataacactgccaagacttttctttggaaacggaagtccaccttggtgtgtttttttaacccagtgtttctcaggtgtagaagcataatgaaagcttttgaaaatttcaaattccaggctataccctgtactgcctggatcacagtttcagtagtgcgactccggtagcagtattttttaaagctcctcattccagcaataacccaacactaacagctgatcacatctgctctaatctgagactggattgtgcactagccataaggagctttctttcaaatgcaaaatgatggcataacagaagtgttcttattgtgatactataatcaaacagagtgatttcattgcttcgattaatatagtctttctacattataatagcacaggcttgatgaaccaagcatatcataattatcctttattgaaatagaaacctcccagcagtgtcctgaagggtctttaagtaccttgaggtagtaccttctaattaccattaataaaagatcaacaggttttagatatccaattagtgtgtacgaaattatcctggtcacttatgtctcagtttgtgcttttttgtgcaggtccacaaccctatgttaatatttttgattgaaaagcttcaaaaaagatttttttcttttaaaagaactcattttatttacaaagcctggccagacctgagctcacctggcagccaacctgacctcagctaaagggaagctacttacagtctttatcccagttgtgtttgagtacaaacatcctaatgctttgactatgggatactgccccagatatggctgccttaaggagtacaaggcgtatgcattatctttattacctttccaaattcccaaagaattgtgaattgcaaaagacatcaggctccaggcaattcagataagggactggtggacctgtgttgtcatcaggccaattccagggtctcatttgcaatcacatagttttcctgctcattccagccctctgccactgtgtgaccttgggcaagtaacttgacctttttgagcctaagtttcctgtctgtaaagtggtgcaaatgatgataatctgtcttaagggtattgtgaagattaagagaaataatgtgcacagagtgttttaaaaatagaagtttaaggaactcgtgaatacaagttcttcctttgggcactgtgatggcacatggtaaaccctgaaatataggttccttttagtaagtgagaggtccaccttgaattacagtgatacacagtaaagtgttgttttcaagctgtgggccaagattgggttttggaatctgtttattaggttgtgaccttgagatcattctatatggaaaagaaatacagtaatagaataaaaagtatttgtgcatttcatcaaagaaaggcaatctttttttcaatacttgcacatttgtatatgtatgatacatatctttttaagagttggggtctcactctgtctgccaggctggagtgcagtggtgccattgttcactgcagcctccaactcctgggctcaagccattctcccaccccagcctcccaagttgctgggattacacgcatgagttactgtacctggcttttatatgtttgttctgagtcatgatcctagtgttgtgggagagacaaacaaaaagaggttggagtagatttttattaataataacagaattattctgttcactctttccagggaatatagatctctgtttttcatggtccacttatttttagtgtactgagatggtctaatacacaagtaatactcacatggtgattgagataattgagaaaatcatggggctgatattagtcaaaagttccttttgcatatactgtccaaaaaatcaaggcccaagatttcatattgattcaaatgatctgaatagttgccttcactctttatttcatattgcatatgcagacccagtattgaaaagtcttcatagaaaatattgacaatacccttctgttaggacagtcttagcataagaaatatgtacaatgaatatcttggaccatggagtatttgtgtagtttatcacatttggaattttctgccccttggagtttgtttaatcgtaagtcaaatttatttatttacttacttagagtctcgctctgtcgcccaggctggagtgcagtgacgcaatcttggctcactgcaacctccacgtcccaggttcaaacaattttcctgcctcagccacctgagtagctaggattacaagagtgcaacaccacacccagctaatttttttgtatttttagtagagatagcgttttgctatattggccaggctggtctcaaactcctggcctcaagtgatctgcccgcctcagcctcccaagatgctgagattaagggcatgagccactgcacctggcccaaatttacttaaaaccaaactttttcttgtcccatctcacttgcttacccagtgttacctgctcatcctgttcctgtgacactgacatcaggaaagccactagctctgtgatttacagttgccttttgagtattggctgaagagaaattttacctctaaatgtaaagctttttaattaaatggaaaatgagcttcacttactttatataattaagatgcagtcagagctgggtgcagtggctcacgcctgtaatcccagcattttgggaggctgaggcatgtagatcacctgaagtcaggaattcaagaccagcctggccaacacagtgaaacctcatctctactaaaaatacaaaaaattagccaggcgtggtggcgcacgcctgtagtcccagctacttgggaggctgaggcatgagaattgcttgaacccaggaggtagagtttgcagtgagctgagattgtaccactgcactccagcctgggtgatggagcaagactctgtctaaaaaaaaaacaaaaaacaaaaaacagatgcagtcagcacttatttcacgtacctgtttagactgtgcttagttgccaatgattgataggcattagttgggtctgaatggacctatggagccatggagcttttatttaacaattctttatctgatgtctgggaagcagaggagaacagagtcacagagccgtttaaaggcataatgttgtcttatttttatcactaagttgattgcaaggtttttgtctttttggaggctatacaacatagtgactggaataaaaacttcagttgcacccctatagcttgctctccaaggtctaagtgactgtgggcaagtcatttcgtcttccaaaacctgtttgcttatctataaaggaggaaaatgtgggtacagaactcaccttgaagaattatgcaaaaaataagtgaagtatgtgtaaaaccattattggaaactggtaactgctattcaaatataaaaatgaatggtgatagaatactggaaaatttctgagaataggatctgtatctagtttatctttggacccataaaaatatagctaacatgctttgtagcagttcattaaattctggaagttagtttgcctgtggatgactgaaagctgttagttttatttccctttttgatatttagatgtgaatatggagaggatggagatagatgtccaacctcttagaccaagttcttgacacagaatatgggactcatcacggttaatagtaatgtattgtatatttcaaaattgctaaaagaatagttttttttggtttcattttgttttttgttttgttttgttttgtttgagacagagtcttgctctgtcatccaggctggagtacggtagtgtgatctcggctcactgcaacctccacctcccaggttcccgccattctcctgtctcagcttcccgagtcgctgggattgcaggtgcacaccaccacactggctactttttttatttttaatttagtagagatggggttttgccatgttggccaggctggtgttgaacacctgacctcaagtgatcttcctgcctcagcctcccaaagtgctggggttacaggcatgagccaccgcgcctggccaagaatagatttttaacattcttactacaaaaaaaaggcaagttggtgaggtgatgaatttgttaatttgccttatttaatctttctacagtgtatacatagatctaaaatgacattgtaccccataaatagacacaatgattgtcagtttaaaaataggaaaattctgctccatcatagatttagcactttgagcaattatgtttctagtgagtccaggtatccctgagtagggtggtatggttttagggtgagggtgccccttgatgcacttcaccttctcctcttttatgaatacaatgactattcatttcaaaattcctgtctcagatggtatcctgaggagccttggatgatgtcagcagtgtggcttcctttcagagagtctggttggcatcaaaatgcaccaagattgcactattctaggaatggctttaaaacaccagctctgtttaccatttgatgatatatttgtattacttaaagcaccagctatgtttactatttgattatatgctttaaccatttatgtttggtttctatttattgttcagtaaaggaaaagctagtagtaccaacattttgtagaaggctgggcatagtggctcactcctgtaatcccagcattttgggaggccaaggtaggaggatctcttgagcccaagagtgtgagaccagtctaggcttcatagcgagaccctgtctctatttaaaaaatgaaaaaattagtcgggcatggtgacgcttgcctgttgtcccagctagtcaggaggctgaagggggaagatcagttgagcctgggaggatcatttgaaccctggaggttgaggctgcagtgagcagtgattataccattacactccagcctggatgacagaaggagaccctgtcttaaaaaaaaaaaagaaaaaattgtagatgagagatagtttggcagtcctcatgagaaccccccatagtgggcggaacaccttgtgtaaacttggtattgtttctagggtttaaaaaatattaataattattatactaattctcagattatattatattaatttctcagatgtgcagttctcaaatctgagaaatagctcataggaagagttctaagctgtgaggttgagtccattttctgattcatttgggggcagaaattcctatctgggaagttagaatgatcatttgtgtaagatcttatttatcgtctcaagcttcaaagcaggattataagcacttggttttcaatgcatgaaaatgcccttggttagaaataaacaaaaagtatgggaatcttaactttactgaaaagatagggcaagtagcttggaacctccctatttggaaagcttaccatagagatctagcacaattaagcaaaaagttagtttccatgaggattaccaagaattatagtgcagtaagccacagcagacagctagctgctgaaatctataaaaacttatttagagacgagcttactcatcattagccttcacttttggagctagagtttttattagttaatttcattagtaaaggaatactcctacaaactggggaagtctcaggtgctcagattcttcatctataaaatgaggatgttggaaataaatgacttttgaaaaatcttccaaaaaaccccacagtgtctagattttggtgctgttttacccccatcccaaacttgtttcttcttccttgatttcctgtcagctctgattgctgtagatcctggatgatgacaaattggtgtctcagagtaaggagcaaacaagacaggagcctcaagcaggctgtccgttgatttgttgtttgggtttttggtctatttgcagcttctcaggtcctagccaatacaaataggtgaggttcttatataattttacactggcaaattagaacaaaacaaaacagtggagggaagcgggagatggacattgagtataggttggacaataacgatagaaaagtggtttggattctttataattatggtctgacatggttccagtaaaggtgtctttggttaaattaggtaatacgtggtgtatatatatacacacaaactatagacacatgaacatagcagctgctaaatttaatgccccagcgttgcttcatactacatgtagattttaatgagtcagcacagcctgctaaaccaagcttctggcaccgagagcctttttaaaactcatctaaacactattattgatcattcacaagtggtggttaaatttttttttaaatagcagaatctttgttacccaaattaaaagttacacagaaccacagtatataaaatagttaaaagccaaacactgccttgttcctgggctccctggggcctccaggggactttgagaactttggttacattgtttgaaaaattctgactaaaatgtatatacttaatatacgtatacatatatacatatatatatatatatatatattttttttttttttttttgagacagagtcttactgtgtcgcccaggctggagtacagtggcatgatcttggctcactcccgggttcaagtgattctcctgcgtcagcctcctaagtagctgggattacaggcacgcgccaacgtgcccagctaatttttgtatttttagtagagacggggttttaccatgttggtcaggctggtctcaaactcctgacctcgtgatctgctggccttggcctcccaaagtgctgggattataggtgtgagctactgtgcccggcctgaaaatttttttagttattgttacaaaaaggcaaagtgtaccaaataacaaaattgcaaaacaccattcaggtattatggtggtgatctgattgtgtttttattttagtaggaagcagttctatacattgaaaatcatttgtgtttaatgttgagtggtgtagaaaatgttcataatataaagactaatgtaggatgagagctaaatttcaggaaggttcagtgagtataaattcactgaaaaaagtatttaaaagtattataaagacaaagatgagttttactaaaaagcttatatggatgaaattaagtagaataaagatgaaactttgtgacctggtgaatttcaaataagtatattaaaactacagtatatgcttgattataaggcaactctcaaatgaggtgatgtcccacattctcaagaagaataacaaataagttctgaatgtataaacttcttgggatataggtgaaataattgaaagtatgttaatatttagttacacatataaaatatgagataaattttagaaaaccttcattttcccactccaagttttcaagaaacagtttttttttgttgttgttggtttgttttgttttgagacggtgtctcactctgttgcccaggctcgagttcactgatgtgatcatggctcactgcagcctcgaactcctgggctcaaccaatcctcctgcctcagccaatcctcctgcctcagcttcctgagtaactggaactacaggcatgcaccaccacacctggctaattaaaaacaagtttttaggagggatgaggtatcaccatgttgcctaggctggtcctgaattcctgggctcaagtcatcctcctgcgttggcctcctaaagttctgggattacaggagtgagccactgcttccggccaagtgaagcagttttatttaaatcctacatgtgcttcaacattacttcatcaccagaaccactttttggctccttctatagtttgagtatgtcatctttatttctaagtctgtatgatatcaattttgcattagcacctcgactttgatgtttttacattctaaattatctacatgatgtaaaaaataattacttggaaagaaaaagcttaagtacattggctttaaaatatatataactgggagattgatggattcatggatgttgtgggttgtttttttttttttttttttttttactctgtcatccaggctggagtgcagtgtcgcgatctcggctcactgcaacctccgcctccagggttcaagcgattctcttgcctcagcctcccgagtagctggcactacaggcacgtgccaccgcacctggttaattttttgtctttttttttggtagagatggggttttttggccatgtgacttacgttgcatgggagtgtatgtcctgctttacaggtattggccttggcctataactcgttcggcggaagaacataaatgaatgtgatgcaagcatatacttaaatgggatgccttaaatgtaattgggattttgtgctaatgtgagtatcatgagaaactatgccccagctacctgctacctcttcagcctggacaccagaatgacgtaggtggtgtagcagacctgattcttagccttagcaggcaggctgaagatctctaggatacatcacacagcaactacctgttggtctatcagatctaatttgaccactacaactcacaaatctaataataatcttgcatttttttgtctgaattagcagaaccagaagttacacttaagataggttaggtaatttctaaattaaaaataactctgggccaagcgcagtggctcacgcctgtaatcccagcactttgggaggccgaggcggatggatcacctgcggtcggagtccagaaccagcctggccgacatgatggaatgaaaccccgtctctactaaaactacaaaaactagcagggcggagtggcaggtgcctgtaatcctagatacttgggaggctgagacaggagaattgcttgaacctgggaggcggaggttgcagggagccgagatcatgtcattgcactccagcctgggcgacagagcaagactctgtctaaaaaaaaaaaaaaaaaaaaaaaaaaaagtgaaaatcagcctcaaaacaaacaaacaaaacaaaaaaaactttggggataatgcccatctaccaagggctatgcagtaacttgggattcttggcagtaggcattttcaagaatacagtatacatggaaaccagatgcatgcagtaaaaaatgtatcaccagccttgagtgcactgttcatttttccagtgagaccttcaaagggtctgtgaaatgaagcctggtgttttcctcttcaaggactcatttttgagtacactaagaacaaaattttggcctctctgttaggcataatttcagagtctctctctacacattcattggattttgcaagatatgtctgtatatatacacaagtggctcccatcttagtctgcagatttgaagcatatgtatgtgcttgtgcatagtcattctgcctctgcgcatgtttcactaaatttattgcatggactcttttatggctctctaaaggaaagtaaacacttaactgaacaaaaagttcagctttacattttaaaaaatttcttctaagcagaagagtttgagataaaacatgtctagtgacgcctccatttatctactgcttacctagtttactcgccaaaatagatcatttaattgaaactatccagtttgtgtgatgtcttcctaaaatacacttaactgattgaagtttgacccacccgttcattattatccattttcattcaaataattaacttgattatgacttcgatatagcactttcaacagccaaaaaacaacgttttggcctttttagtacttttctaccctggtatttcacgtgagactcacgtggggagctttaaaaaatagtgctgcccaggcttttcccccaagattctgatttaatttgtttggggtggagcccaggcactggtagttttttaaagcctcccaggtgagtctaacttgtagtcagaattgacagccacagctacagctacagctacagcgtttttgtaaactttattattgaaactaagcaattcaggttgaaatttgttttacgtgtaggattgtcgtgataggtcctctccagtgttcagatcaacctgataatgtcagatcttctaggaaattggtgtcatgtttgcagcgttatttatctcctattttcaacgtactttggggccattcttggaaggctgatcgggaaaattagttgcataaataaaaccttaatgctagcctggggataactaccttcctttatgactccagctatttaggtagtactcaaagttgcctcttaaatcacactgcctcagtcaactttatggaaatggatttaaatagtggtgaactttcctccgtcatggagaggagcccagtggatttgctctggtgacctcagtcacactcagcacagtagagccttgttagggacccaggaggcagcagtcttacctttctctgccagatgactatgtaaatagtcaatgacaggtcgctataaaagtttcaaattcctaaatgaaaaccaagttttccaaggaagaaatacaaagccttagcatgtgtacttaaattaaaaaatacttaagtctactggaactgtgtatttttttctaccacatgaatcttttttagaagaggggattttctttctcccctagccagtaaatatttatcttttggatatatagaccagctgcatatactgcatggattcctttccattcatatgtgaaatagcacatttttttccactagccagcaagactcatactagtatattactcataataggatgcattgagtctttttgattcattcttgctcttctaggatcctcatcagcttccatggaagtttacgatcagtttcttaagactggctgcgatgggttttgcgtgtgaggcagtgtgcttaaggttctagactcaaactttttggatttgaattctggcttttccacttaataactgaaggacttagtttttaaaagacttctctaaaccatattttctccatctacaaaatgggaataatcattgctacctatctcatagggcagtagtgagactcaaatgaggtctttcaagcctttgaaacagtttctggcattctgtaaatgttagctgctgctgctacctacccttctaattactggtgtaactgcctgatactgtccccggtattactctttgacataattataaaacatcaagtaaacacaggttactggtgaattaagaaaaaggatcaacttttttttcctaggcctcttgtaggcagtctctcctggggtcttctgtttcatgagtcagaggcttatctctctgtgattacaggctcactgggggcaggcacctattttattttacctagataaataaataaatccaatcccttcccatgtaaaatttttgtgtatcagctgtattgaatacttgtgtctattaatatgaatcttatgaatagtcttattgctgtaagaattccataaagactggacattgtttttcatggtattttgactctttaaaaaaacacacacgcaaacagaaacatggtggagtggctgaaaattggaagcttaaatttccaagttcatgtctgtgtcactgtagaccctgactggaaagtcatcatttccttgaacctagaggaatgtgctgaaacagtagtaggtgttggttaaaattagaaccaactatttccataaccagaattacagacacattaaaaaaaaaaataaagtgacagaaatctactagtttttccttgtgtattcaagaggtttttgacccagttcagctaactacaattggattctgtccctggacttggcacataacaatgcatggtagactttctagacctggcgatggaaactcggaactcttcccaggtatgagcccttaaaaaaatgtcatcaggatctgaacagcaaatgacagtgacttctcatgttgtctcctttgtgccctccttccctgatgctaagccccaggaaaagattccatgttgacattatttgtgtttaatagctcattactgtgtccacgctctccagctttcctttactagcagtgagcctgccaaggcgccagcactgcaactacacatgtttctagactactgtatgaattgctcatctcttgaagctatttatttgtagctaatagctagcatttgttacctcttgagaaccagagaaatgcacacacagtttccatggagagggggaaaaaaacccaaacaacctatgatccaggatcctgtttttgtctaaggaatgcagtttgcttgagcaagactcttaagatgtatttgtatagggtgcagatgttagtcattagtgcttaatgtatgctgagatgggaccagctaatggaccctctacactggtcagtggtgttgaatcaagctattgctggaaggtcctgaggaagtagtttccaacggtaatggccctgatccctttgcatatcgtttcttttggcctttcctccctcccatgctgaattataacagagtcactggtgtgcaattccagaatgtctcagttttttcatcagatacctaacatttacaaaattactttaaatatttgcctcagtccaaggtcttgggactcagcaccttttttcttgcttacataatttaaaaagtctatggtgccattttctcaatgaacaggactagtttaaaagagagatattgggccaagtgcaatagctttgcctgtaattccagcactttgggaggctgaggtaggaggatcacttgaggccatgagtttgagagcagcctggccaatacagcaagactgtgtctcttgaaaaaaaaaaaatagctggaagtggtggtgcctacccaaagttctagctacacaggaggctgaggcagaagtattcagttgagcccaggagtttgagaccatcctgggcagcatgagacctcatctctataaaaaacttaaaaaattagccgagcatggtgggtagtcccagctactcaggaggctgagatgggaggatcacttgaacccaggagtttgagattacagtgagccatgatggtgcccctgcactccagcctgggtgacagagtgagaccctgtctctaaaacataaaatgaaaagagagctatcaatggctttaggatttgggctgtaaacagtgatacagaagagatgaactttgcgaaagaataaaagatgctcttagggattggggagtgtctggtgcattaatggttcctgtcttgggaaaaagctgtgtgtagcaatgttcttgggtgttcacagtagctcttgtatatgagacgtggtcattttcaaggttgttcaccagtggtagaagaatagatggcatttgatgcttgttattttatacttttaacttttaaaattattctgtaatttaaaaatattctggggctgggcatggtggctcccagcactttgggagtccaaggtgggaggattgcatgagcttagaagtttgagatcattctgggcaacacagtgagacctgatgtctacaaaataatgttaaaaattagccatgcatggccgggcacggtggctcacgcctgtaatcccagcactttgggaggccaaggcgggcagatcacgaggtcaagagatcaagaccatcctggccaacatgatgaaaccccgtctctactaaaaatacaaaaattagccaggcatggtggtgtgcacctgtagtcccagctacttggaaggctgaggcaggagaatcgcttgaacctggtggtgcacacctgtggtcccagctactcgggaggctgaagtgggaggatcgcttgagcccaggaggttgagccgtgattgtgccactgcactccagcctgggggacagagtaagactctctgcctgtcatagatagatagatagatatagttttcaacctctaactggttttgtgtgtgtgtgtgttgacaatttatctgatggttctttgaaaactgaaaatgtgtccttcattccaacattatacatttaaaaaatcgaatgttttaacataaatatgggaggagtactccatgaaggtgaaagccagtgattctccttgaagaagggtattgttctgtgctagcggcatctccatttcgcctagcaattgtagcagaatagagactgcatcccctctcattctacaggtaaagaatagtttgaagagaaagcttagtgatttcactgccaaaagaaagcttttaacaaaattgcttattaaaccacacctcaggctgtgcagggacatgggaggagcgtgcaatttctgaaaaagaatatttagaggaggattttattgtataattggcaaacttctcatctccgagaataattgcttgatttcatggaaaggaccagaacttgggtatcttgaggcctaagataaatagatagcaacggatcatgctagtccccatggttactgggaactgagctcaagtggattgttatcctgaacaagtctgtgtcaggatattcttgtcacctttcagctctttggtatttgctctctttcttgaatcagcaaaagaaatcgctgtaaagttaatgtaatttacgggaagttcccgtgccacactgcatgcttttgtgtgtcacaagacttaagcttcctgctaccctctgttaaaggagaactttttatgttcctaacaatatacgattctttcaggagctatttacatagctgggttggttaatagacaactggggactgggctataagcattttgacctggaaatatttctttggggttatgtgaactactgtacaataaaacctcaattaactaggattacttggagaaaagacagtttctggttgaattttcttttaaatggaaggttaaacactttccttttctcaacccttcttattcactttcttcctttggcttttggaattcagatgttaagatcttgaaaataagttaatgtttcattgagttagtccgtaacagtgctttggaacatccttgagttatgaagcttgttattcaggctttactttcttcagaggattaagaggcttgaacgtggctgctaagttctctaagttgttttctggggggaagaataaatttttctgtgtaattttgttttcttgtatctttatcagattcagaataaaaaagctatcgtaacatgccctgcatcagtaggccttgttagttacgtaatcctactatttgagggtttaggaatattctagcaaaatataacagaaatgagccgttagtaaattgcttaacttaaaatatttagttttcttctgtgtgtgttaaagtcaagttatattaatttaataggcagttgggttggctcttttgcataatccagacaatatatggatcccacaaatatttattgagtatatactctgtgttcttcatataccatgttaggcagttttgtaatatcagtaatgagaccagcataagtgtattaacctctgataaccttcacataaatcttatattctacagcaatgaaaacttgtccctaagggactttgtggtcacagcagttctgatttccttgtttgaaatttttgtaaactttccaacttctttgttttgcactcagtacttaaaaataaatttaatgccagaagtaaaagtactattattttcatcaatcataagttatagataacaaaaactcagaaatttttcttgaacataggtagggaacttaggtgaaaggactgctttaattccatctaaaagataaaacctaatactgacttacaaatatgttgctaagagtttagtgtctccaagtaaaggtagaaattttacattatctatcaatgatatcggcgaaaactaaaattattaggaagtaagctaagaataatttatagtctagatttttaacttaaaagtggaaccaatttccaatggtttcttcccttagttcttgagttagccatactgtgaccattaaaaaacatctttaaaatgtatgtgaaaaaacctgaagaaaatgtggcaaagggtaagatttgataagaaatgggtctaggtttatagggaatgcattatagtctttatagttatgtgtgtttgaaatataataaaacacttttagatgaattctttcttttttttttttttcctttttgagacacagtctcactctgttgcccaggctggagtgcagtggtgtgatcttggctcactgcaacctccatctcctgggttcaagtgatgcatgtgcctcagcctctggagtagctgggattacaggcgcacaccaccacaccagctaatttttgtatttttagtaggagacggggtttcaccatggctggtgttgaactcctgacctcaagtgatacgcccacctcggcctctcaaagtgctgggattacaggtgtgagccacaacgcctggctagatgaattatttcctttagaaattattttctgtgtatctgcaaaagtgtttcattttagtactgtgaaatgaataggccctatgctgggtcctgttggggtttgtgatttatagatggtaaaatacatttcacacttacaagatgaagcaatctacctctatataaagagcttgcctgtgggtggttgtagcaagtgtcttcttattatttcacaattgagggcaagagagaggtcagaccattggtgaaacccttagtgcaagcaagtccgcaaataagctttttagctacttaagcctaggtgttttattggcattgaaggccaagacacacgagcaatacttgcacaatcaaaagttctatttttccaagacatgctggtcacacaagaaaaactgagataacatataatttatttttccaagacatgctgatcacaaaagaaaaactgagataacgtataatttagttactgtgtatccactttggatccagattgcatatctatatctgtctgtaaacagacatatgcacacatatatatacctgtgtgtatgtatatatgcacacacacacatatatatttaaaatcacagtacttaattaatttgcctccaaaactaatggccacattaatgcctttgagctaagttagactggctggaatcagttggcaagatcctggtaaatggttttggtgtcaactaggacacaagccaggtgtggtggctcatgcctataatccttgcactttgggaggctgaggcgggaggatcacttgaggctaggagtttgagaccagtctgtgcaacatagactccatctacaaaaaataaaaaattagccaggtgtggtagcatgtgcctacagtcctagctatttgggaggctgaggcaggaggataccttgagcccaggaggttgaggctgcagtgagccacgatggtaccactgcactccagcctgagcaacagcgagaccctgtccagcagggtagagtgcaaaggatgcctgtggaatgggagaatctgttcagcatccatcctcctgcttccaggctaaacccatgagaagagtgctgtcaacaaaagaagtgttccctacagtggggaagaattgaggttagcagaaagggtaaaacaagaacaaagtaattcctagccatccgaagaggtggaatgggaaaggcaacacctataacaggaaggaaatactccatctggggctgagcctgtcttattctgaggcccaagcttggctgcctttctcttcattccctctgtgtgccacttaacagtatgcatttcaactttcttttcagggaggggccagatgtagaaatgcctcacactacagtggaggagacctcaccagctacctgtaccagtaagatgggattagctcaggaaacgttgttgtttgtttgagggacaagaataacatgaaagaaggagcaagattaacagaacagctgacctagagctgctaggcactggatggtcctctgtgcttatatacacaatgtaatacttgtaaggaaaaagcaaaaggcttggaggaggctgtggactacctatagttgacagtattttcctttgtgggggtggtggatgtgggacgtagaatgtaaacttcctaccttatacattgatgttacttcattgattatagtgaacactttatagactgaaacaagtctaagaaaaattcatcttgagctgaggagatagagatgacctgccaaagatttcacatccacaaagtttgtatgactgatagttttaataaaaaaaatttgtcagccaaaacatactgagagtttcttagtcgtattaactgatctgaaactgttgccactaggggatataaaagatactacctgtattttagtgataaaccacaaagaataaaatgagtttttaattagcatcatgcagccacttaagtattagcaaagaaaatttgtagctgatctttcagttctctgtaatatagaaaaacagatgctgcatctctagttttgcctgtgcctgggggatatttaaaacttgtactaaaatgttaatttcgccatggtagaggtgacggggaaacttgcaaaaaaaggggaaagaggagggaattgggtgcatagaagtgagcatgaggccagcagtagggaatgagtttacaataaataaggtgtgagagtggttggggggagtgggagaggtttgggggctgggaagacaagggaaaagaaaatgcagggatatgctatttgtgttcattttgtctttgaaaatcgtaagtgtacagcatcattctcgggcagagtctgggaggacttgagttgactgctacagtttatgatcttccctaaacatcgacgttcctggaaatctttggcctctgagctgacttcttctctgttgcttgtgagccaggaatttaacagctctgttgtatgtgcaggctgcagatgcttctcttcagcttttgctatccaatgtgtgtgtgtgtgtgtgtgtgtgtgtgtgtgtgtgtgtgtgtgtgttggataaacttaaaaaacctgttgcttccatgcaacggcccacacaacttgggactcatggtcagcctcaccttccacattggctaaaactctacaggaaacagtttatggagtttaaggaaaaaaaaaaaaaaggaaaattatcagactccaagcaagttatttatggaccagtgtgtgaacagaacatctgattgaaaaaagaaaaaattacagatgggtggggatggaaaggcaaatgtgttgtgtagctggccaagtaatatctggttgtgtcaaaaaacgggaaaaaacatcatcttcaatgagttacgttatttgtattccttccatcttgcctgccatgtgccttggataatgctgctgtctattaagccctctgtgtcctactccctcgccagctttgctccattgtgctgttggtggggacacagcccaggtggttgggtgatgcctgtgctttcctcctgccctcttttggtgttgctatttgaaaatcacttgtataatgaatgtatcctctccccactcccattgttatgtgaaaaaagccagtaaaaatgaacatctggcaaagaaactgtcccaatttaaggaggaagtttgctagatttatgatcttcctttgtaactcaagtataaactggccactatctgaggagtgaggtcttgctacacagttttcagggtcagggggccaggcaggggtcgggtagggtgagtggaagctctggggttgccgcctaggctggaaaaacactgtgcatcagctgaatggctgccggcctgccaggatgctgctattttctatcctgattcagttttgtgaaaggacagtgggtgtgaattgttggctgggtctctggatcactaaccagaaataagcttagctaaattgaccacaagaaatttcactgttttaaatcccaccagccaactccccaaattttgccttttttgtctctttccttgaaattagtttaacattgcatagtgtattttatcttcataatgactacttaaagatggttttaaaactgaactatagatcagccagggtgtgatggctcatgcctttaatcccagcattttgggaggctgaggcgagaggatcacttaaggtcaggagtttgaggccagcctggccaacatggtgaaacctcatctctactaaaaatacaaaaattagcctggcgtggtggcgtgcacctggaatcccagctactcggggggttgaggcaggagaatcgcctgaactcgggaggcggaggttgcagtaagctgagattgtgctactgcactccagcctgggcgacagagtgagacttcatctcaacaacaacaacaacaacaaactatatattgtaaaatagagttatactgagctaaagtatacattttaatcatttatgtactatgaaaaatagtaaattgcttttgtaaaaataaaaagtactggcatgaacacagcattgttccagtggaaggagtttgtgggtttcagaagtttattaccctctgatttagatatggtcctgtctgttgaactcacggtcatggtataatgacatctcttcattccgtcccccaccctctgcccccagaacaattaccttgctttatgtaatttcttgttagatcagtctctatctccaaaagcaactggaatagattaaatcaaggctcatacacagcctataaaaacaggaacttcatttcggggaagatttttgtaagatcgttttctaaaatagcatagtatcagaaatatttctgtaatgcttttcggcaaggaaattagttcaatatttttggctttgtcaactcagttctcaataatagctgtactctgttgtcattacagttttggcttttctcaactggagaatgattttatattaagtgctttgtaattatttttttcttgcatttttatctaaggctttgtaaggggggtgttcaagtacagcgtggaaccagattcttcttttccttatctttcataattttccatgtttgttttgaattaattagttttgattcaaacaaaaaaactagcattttaaaagatctggtgtttcagtattttgttttgtttaatcaccccttgtttcttttgacactaaatttttctcaggaactaagcagatcggttatcgttcctctactttgctttattgaactccctaagtgaaatttgttttaacaaagaggcagtgtttatgtgttggtgataaaaagaaaatagccgatatattattactttttttttcttctatgtcaccttgttatgtaaggttatttcattacctttgtagtgtttttcatggaaaccgtcaacaaggaagtacctaacactgcccaacatgaagccaaccataattgtggatagaaatagtagactcctacttcctagccttaaagaatgtataatttagttagcaagtgaaatcccaaggggtacatcataaagcaatgaatgattcaaattggcactgtaagaataagttctaggtggtatggggcagcctataagagctattggaatttaaagaagcaagagattcttatgcaattatggaaaatgttctcgaggtagaggaatttgagagttcaaattgttttctcatcaaacttctcctcattttagattcagcatttgataggtaggcttccagtgtaatttcttttttcctgttaacaaaatgaacctcagaattctgaaaaggaaagatactgattcattcaaatctcaaatgtcctaactttatagaagaatgtggtactatggaagggcacaaatcaaggtgctgttaatatgagcggtgttgtagtttggatatttaaccctctaaacctcatgttgaaatgtgatccccaatgttgggaggtggagcctagtgggaggtgatttgggtgatgggggtggatccttcatgaatggcttggtgtcctaatgagtcttcctggtgttatcactggtggtaatgagtgagttctagccctattagttcatgcaaaatatgtttgttaaaagagcctggcacctctgttgccacgtgatctctgcacacagcagttcctcttccccttctgccataagtggaagcagcctgaggctctcaccaggagcagatgctggcacaatgctttgtgtacagcccagagaaccatgagccaaataaaccttttctttagaaattacgcagccttgggtatccctttatagcaacacaaatggactaagacaaatagtcacctttaatttgggtttgtaggatagccagtgtttaggaccctgtaattttgcttttaaaaccatgaaagctcatttcagatattaacaaagcatttggcttacatatcttatttgcttggtgtgtacacaggctggattaaaaacaaaagcaaatacagtttggaagaaaataaagccagcagcatcccctggtgaatccctttaaccatccaccccaggaatgtctgcagtgctggttagggcagagtggggcagttcctctggaagacggtatgataaacgagggtcacccaactgtgaggccagaggaagggagactatcttcaggaagctgtgagcttttccttttgtatggagagtgttttgttggactaaagttgtagaaggcatttgacctctgttattgtatttagtgtttcaacctcagcatctgacccaaaataacacatatcttttcagtaacttgggacagagctgacaaaaggcagtcaaattcagaaggagtctcattgtaaaagaaggattataaactacacaaagagcaaaattagtagggaaactaccaccacaataataatgctgcagtgttttcagagctgatatgtgattgtgtttttcctgtcttgattgtttttaagtttggtctgaaaaatacgggtatcaaattaaaatttcataaactgctacgagtttctctccttccagagagaaaggatattcatttgatttgagaattgtcgttttggtttaattaacagttgtttgaaggatgttaaaaatcatcgtggtgaattggtttttatcctaacaattgcatgataattttagattactcttgaaatatgcctcaaaataaaaagttagatgtagtggtcctttctcatgtgccttgactattgtcagagaaagccctgggttatcagcctgtttagaagaagtgacctggtacgctttttgactcttggctctgaaatcttatcatcaggaggaccatgtggattttattcatttgacagatacttactgtgcacctattatgtgccaggccctgttatgcagaggacaagtagagtagaaaatagaactactaacacttgcaacacacacagtcaactcttttgttatagctcagtttaattaacagaaggaaaaactttgcgttggggaatacacataacacctggaaacgcagcgttggaacacccgatttgtctatgatgcttgcttactactcctattattctatatattacaaagcctgaatatgtaaatggcagttcaatggtcttttaggaaaaaaatttactggaaatatactaacaggaataacactaaggaattcaggagctacaagaattcttggagttctgttatttcaggtactttctttgaagtattaagtacatattatcagtaagttttgttgtgttcctattctacgtagatcatattatcagatagaatgtaaagatagattaagatgttcatgctgggccaagtgtggtgactcatgcctgtaatcccagcactttgggaggttgagatgggcggatcacttgaggtcaggagttcgaaaccagcctggccaacatggcaaaacaccgtctgtaataaaaatataaaaattagctgggtgtggtggcacattactataatcccagctacttgggaggctgaggcacgaaaatccgttgaaccctgggaggcagaggttgcaatgagccgagatcgtgccattgcacaccagcctaggtgacagagtgagactccgtctcaccaaaaaaaaaaaaaagatttttttcatgccctaaaagcttttacacctcctagttgagaggacaggatacacatacacacacacttccctacctgcctgcctgcctccaggaagcatatacgaaatgccaatcaactaggatgccttgtttagtgttaagaactagagaatgacgtggatagctgttctgattctacgttagtatttcttagcttctttcttaccctagtcatttcactattaggttggcaatagtaattccccatgtttaccccagcattaagcttgtgtatcttctatcagcccataccttataggtggcaagattaattttaaaagaatttcagacttaaaaaaagttgcaaactagtacaaggagtactagttgctatataatctttcttactttccccaaataatgtctcacataatcatagtgtgatgatcaaaactaggaaattaacagggacacaatactattaatcattgtcctgctgatgcccttttctgggtccgggatctagggccggttcctacattgcatttagttgttatgtctctccagtttcttctaatttggaacagtcagtctgtctttgttctttatgattttgataattttggggattactgaccagttatttcatagactttgattcaggctgggcatttttggcaagaatatcgtggaagtgatcttgtgtacatattagtgcattatcatcacatgcccatggtatctgcatgtctcgttactttgctaacttgatcacttggttaaggtggggcctgccagatgtctccacagtaaagctatgatttttctctttgtaattagtgtcttgtggggagatactttgcaactctgcaaatatcttgtttcacatcctacatttgctaattaattttagcgtttgttgatttcctggctgcatcaattatcactgtggtgtttgccaaatagtgatttttaaatttctgtcatcccgtcatatgagttagaattctgtgagggtgagctattccttctcctcttattatttattcagttatttatatctgtatggattcatggatatttggttatgggttacaatctcttcctatgattatttattatattgctcaaattgttccagatttggctattgtgaggtccttaaatttggcttgtaatgttcttttgacatgttccaatttttggaccaatttcttacttttggtaccataagatgttccaagcttatcttggatttttttttttcttttcctgctccagccctggaatcagtcatttttctaagaagctctagttcgccttattagagaaaggtatatagaaaccaaaatttggtgctagatgtgcttattgttcctaagatgtcagtacttctagccgttctcaacagatagagctaggaagtatatgtgtatacatatacatatgcacacgtttgtatctatatattaaaaaccttagggttcattctcactttcccccttatatgtaactcttttatctgaatgtgagaaacctggttgtcattatccacaatgtgtttacttatttgtgcaattctaagctacacacatagtagttttcagaatgctaacacataccccacgagaaatttgctaactagaatgtaacatttgtgtgcatttttttttgtttttagtgttagaatagagtactgttttctaaagttatttaggttcttctctacctactttgtgcttttgttcatttgtaatacattaggttctcttatttcattttgattaaaatcatgttggttttatttatttttaggtgatgtcaaatattgtcacagttctaagacttataaatacatgaaaagtatgctcagaaggtgtcatttcttcctcattctttctgactcattcctgtcctctttctgtagataatctcattacttcttggtttatccttcctgtatatatattttttacacacatcagcagatgcatactgtattttcttatttcctttttttatacttgaaaggtggtattttttgttgttgcacaaaaattgccacaaacttagtggcttaaaacaacacaaatgtattagctcatagtttctgtgggtcaggagtttggacatgggttagtcgggttttctgcttttctgctcagactcaccaggctgaaattcaggtgttggccagggtttcgatatcatctgaggcttgggagtccttttccaagctaactggttgttggcagaattccattgcttgcggtggttgcactgaagcccttatctccaagaagctgcccacatgacctctccctggtttgtctcttagtagtggctctgctgctttggatttttctaatattttctctagccctagactatctttaaagggtatacttcttaaggtcagacccacccaggataatcccctttcacctttgccatataatgtaacctaatcatgggagtgaagtcatgtcatactcataacctatctacagttaggaggagatgataatatatgacatgtgccccagaaagcaggaatcttggaggctatcttaaaattcaccttttaccatgtagcatactataggtagaattgcaagatagcctccaagtgcaaaaatttgaaaaagtattgttatattgtctatgctttttctccatgagatgtagagtttttgttcaatttattaaaaatactaattttggcagttagggtttgaatttctgttctagtgttatgtttgtattttaccattttttttaaaaaaatgcccacagccacaggtttcttatttaactttatattatctgggttgtcagtttttaaggatattcttgaacccttacctatttcctgtacaccaatccatgaactcagtcaaatttccagttttactcttccttcttctatttgtttaagtcgtattacttctatgttgtcacaacatataatattgtcacattgttctttcagctctgcatttcgatcttctggcagattttactgacgataatgtttttgtgtaacatatattgttgctgtcttatatcaggaatctctctaccaccaccctttttctttaaaaccttgagaatactgagatttgggagatcatcaaggaaaataaaactgaagacaaacaaatgtacttacctgaatgttcagagacctcaccattcatgtgcattattgaaaacatggcaaatggttcctacttcagaaagaggcagaattagtcccccttcaacttaattagtgaaggaatttggcatctttgtaaacataaagggcctatgtggttcatgtatctttctgtaaggcaataaccgtgaagggcaaaggggcccttagttaattataacttgagtaggatgggaggggtcaatggcattttaacgtagaagaaccaagtgttagtaaagagcttttcttctccgggagcttggtcagctatgttttctgtgaagcctgattggggagtcaaagtcccagtggaaaagtgttgatgagaaggcagattctagaggatcaatatttcgaacctccttttaagctcatccaacttcacagctaaaaagctgttgaggcttcagaaaaaggaaaggcacaaaggaatgaatgaatcagaatttgcctggatgtgatgttcctgatgatggtcaaaagtcctgagagttccagccttgaggcctggcttccctctctctgcaggcctcttgctggttgcttttggaggaagctgagtgtttgggttgttgtgattgctgctgttggggatttcatataacatagctctggaaggtcttgtactcatgactattagttattcaaggccacctaaaatctaaatcaaagaaatgactagacagaagtgaaaaaaagggcctgattcgtgaaacgatttcccaactttgtgataggtcactcaaggcttagtgtaggcttttttcaaggtaggtgtcttttaggactgaatcggttccaagctatatgagaaagcttgtgtgtgaataggtttctgctggcagatggttggcaggctcaaccatcagccttccagacttgggattctaacaaaattctattctgtggcacaagcctagaataagtatgatccatataaatacattcatttatgcacatattagcagtacactgagttcttgtttttgtgattttgatgatctggtgcttttggttttcctaatactggttcatggagaaataagttgtactgtgttggctaaaacccgactctggatgcactaaataattcttctgagtttctttctctttttcctctagcctggaggaagtctgtctgctttctcttttgcagtctggagatagagcattgacccctgaagcaatgctgggtttactttattagagctcacccgcagatgttaatgaaagcagaacagtgaattagtgctgacttcagagcagaacaacttgggtgggggaatctgtgaagagaacatgttgttataggcaacacccaggggaaaattgacaaatcacagtaagaatcattggatatttctgccccaccaagagagcaggagggtgagaactaaatcatcctctgaaatacacttagattaagaaatcagtctgatgttcatttcacaacattcatcagaaagaaaaacaggactgatcccaggcaaaatttattggtgggaaaaatgtcgtgttctatctcctcctcctctctgcttagccccccagcacctgattaattaaaactctgccatctaccggctcagaacgtttttcttagaagcacctgagattcgttcagctaaagaatcaacagctgtcaaccgcagcaaatagatcccctaccctctaccatatcccagtatcctaacaatgccttaaaatgagcatcaagccgggtgcgatggctcacgcctgtaatcctagcacttggaggtcgaggtcggtggatcacctgaggtcaggagttctagaccagcctggccaacatggcgaaaccctgtttctactaaaaatacaaaaattagctgggtgtggtggcgggtgcctgtaattctagctactcgggagactgaggcaggggaatcacttgaaccccagcgaggcagaggttgcagtgagccgagatcacaccacttcactccagcctgggtaaaacaaacaaaaaaaccaggcatcaaaactcggatgtctacaggagtcagttaggtctcttaaatttgtaaaatctgcctggatttgacacaaaagggagtggtggaaccttggcaagcctgtgagttaagtccctgaccgaggcaggcgccactcggctttagcccatactggcaaggcaggccggtgctgtgagggcttccaaattttcatgagaagatgaaaattttgattcttctatgaaatctttcacatttttcatgacggttttaaaagttttacaggcagtaaaaacaattctttgtgcccttatgccctgaaatcaaaccctgtgggccagtaattcccaaatagagtcctcaacctaatatgctttccttaaagctaaatgtatttaaggattatctctttattttgatatttttatccttgctatattgttgatgtaagaatgtaattgcttttctaaagtgactcggggatagggttagcttttacctgcattcagttgaacttgaaggatgaccttcccaaaagggaactcagaaaatgtatctgactcttctaaaagacatgtaacttaaaagcataattctttatgagctgatattgagagctcccaatgggttgatggaaatgctaatgaaggctctattcaattgttaagtttatcttcaatgagcagccagtacagaggctccaaaccaaactagccagcttgccctgatgctggaaagcaaaatcccccaggatgtccacggttttgggtgagagggtctcaggaatatttacacagaagggagcaaagagcctgattgtgttcctggctttaacaagtaaagatattctgtttccatctgtgtaaatttgcgtgacttttttttttttaattttgagtaattaattgccaagactccatttagaaggaagacgatgatgagaatgaatcttgtgaaagtccatactgtactgtttctctaatggggtcctgtgaaccccctgcgatttacatattggcagaaggtccagtgtacactttgaatgtgatccaaacgttctagttcatttaaatttcataagttatagtttccggaaggagaaactgtaactgcatggtagcaagtatggaaaggaacctagttttcactgttatgccctgtcatttaacagtagctttgagtagtttttaaatcaaaaacaagaaaatgttgatgccttaactttttaaccccttgttcttcgtgcgagtctatagggtaagttcttcttgtggaaaacacttgggttattttgggcgaggtggcgctaacagagttttgcttgaggatgtgcttatctgattctctcttcccattcaaatataggattgattgttttcatccttggagcacccactaggtacaaccctgttggaaaccttaatggtgaaagcagcgtctattcattgaattctttttaatgtgtcagaaactgtgctttgtgaaacacaggttataacatttatttttcacaatggtctatgagagaagaatataagagggatggtctccaagataggaaaaaataccgcctttgggccgggcgtggtggctcatgcctgtaattccagcactttgggaggccaaggtgggtggatcacctgaggtcaggagtctgagaccagcctggccaaaatggtgaaaccatgtctctactaaaaatacaaaaattagccaggtgtgatggcaggcatctgtagtgtcagctactcaggaggctgaggcacgagaattgcttgaacctgggaggcagagattgcagtgagtcaaggtcgtgccactgcactccagcctgggcaacagagcaagactccgactcaaaaaaacccagaaaacccaaaaacaacaaaataagtaccatctttatttcattgtgcggagagtgggagaggaaggtacagaagtatggtgggtttgcgagtttagtagcaggaaagggagcgagttcttgtataagggggtttatttccttcatgacatacaaggggtgaggctatattgagagaagggggtaaggagagggtatggaggttggaggttggaagagattgtaaatggttgaccagaagaaggtagatgttccctgggcagtgttgagggtagatgttttccgggcaagtgatagttggtgctctgtggttgactgatcttcctgttgcatggcactctctgcagtctcaggtgcttctgtatcaggagggacaaaatggtattaaagaggaattactcatgacactcgttcaagatggtaaggcagactttatttagtaccatcacgataggcgtagggaccactgcagtgggatttttgcagtgagggagagagattgagctcaattctgaacagagcatggacaaataggaatttatagccaaggagtggagtggaggtcagtggatggaaaattactaggaggaaacatcagggctataggagtgaagtaggggaagaaagggagagaattctggttaaagtgatcctgacctattataggattcttgttgaaggcaggccagggtgatcagataccatctggggaatgggagaggatgaggaacccaattaattagtgggggtgattagacatagagggtggggaattctggataaactgacttagagttcttgccaaaaccagattttataaggaagtgtatacacggatgtaggagaatgtaaaggagcctgactaaagtttggtcaagcaaaaaatctatatcactggtcagtgagtttgtctaggtttgggggtgtgttgggggctgtgctaaaaagacagctagaggagcaagaaacactggtgcaagatcaagaacattatttacctgggccatggattctaagttgggtaaggagggaactgcagaaaagagtgagctgatgggagttctttactaagggtcagacaaatttggggaaggtattgcagtggggaaaaaaattgttaggacaagagccaggatgttctctcacaactgcatttccacccttgcttcaggtgggggaactgtttacacattccacaatgaagaacaatcaagctgggcattgtagcacatgcttgtaacctctgcgctttgggaggccgaggcgggtgggtcacttgagatcaggagtttgagaccagcctggtcaacatgacaaaattccgttctctactaaaaatacaaaaattagccgggcgtggtggcacgcgcctgtagtcccagctacgcgggaggttggggcatgagaattgcttgaacatgggaggcggaggttgcagcaagccaagatcgtgccactgcactccagcctgtgcgacagagcgagactctggctcaacaataacaaaaaagaacaatcagtatgtcctttgctaagatgactcctacccacatgcagggaggcttttttttttttcttttcttcgagacggggtcttgctgtgtcgcccaggccaatctcggctcactgcaacctctgcctcctaggttcaagagattctcctgtctcagcctcctgagtagctgggattacaggcatgcaccaccacgaccggctaatttttttatttttcgtagagatggggtttcaccatgttggtcaggctggtctcgaattcctgacttcgtgatccgcctgcttcggcctcccaaagtgctgggattacaggcatgagccaccgcgctcagccgcagggaggcttcttaaaaacctgtttagtgtctctccatagccgcatctcattgtgtgtgtgtgttttaatatattcatgctcaaaattttgagaaatgagtaaatgggttgtttactgaatgtaagcttctatctcttatgcactgaggcacttgtttatcagtagacctaagaaattatgtacatacggatctcatctcagaggcttgtaagagatgtagattcctgggcccagatctcagaattcctgaatcattactgtcaggcgggggcttaggaatgtgcatatctgtgtattaatactctgaagacactcagagttctagaaggtgaatgctgtcattcatgttcatcttaggccttaaatgtagaaaatactgacgtgtaaggaaaagcaaaggtgaaaccagcaagttaattttgtcttgaaatgccatcacatttaaagcacagttcttcagaaatcaagttagagggatattgcatgatatttccctctgtttatctaaagttatttgtagtatttctgtcctgtgtatgttatgaaaagtcacacacgagtctgctcattctttgagagtctatatttactaagtcagaagatttttttttttaaaccctgaagcatgagagattttgtgagaaagaaaatctttgcaccttccatttttagagaaaggaatagtagagagtcaagtgtgaaaaccagccactgggtttcttgggaagaaaaaatatagtgttaatgagtaagaaatgttgttttgtatgaagaaagatattaaaatttatctaagggcaggttgagttacaaggaaaaaaatggatagaattagaaacaattccaactgtgactattttaaaatgaaatattaaatttgttacaattgaacaaaggagaatttagaattaatgaattgcttttcttgtaatattttctttactcatttcttcttatttctttaaataaggaaacccaagtcattacttggcttattattacaggttatcaacaacttagtaaaacgtgcatgaaatctgtaaggtacagagcctaattcgtcagtagctttggcagctagatgtgctgattcactgtctacccattgtgacttcagagtcacaggactgtgggttagaagaaggatactaagggtcatcgggctccagccggctccagccgtgtcttcgagtgtctgataatgagttatttaaaaaactgaaacccagaatcacacctctcgttcttgcttagctagtaatacaagcagacattcataccttgatttcttcaacatgtaattggcttgtaaatcagggcggccatataattgatcatccagattggagtacttttcgagtgaaagggggcattgttaataattatgccaggacagcaggcattttagatttgtactctatcacaaagctaagttctagcaaatggttttgaaaccgtgtttagtctgaaagatttctttagaagttacatgtgaaaaaaacttacctagattgaagtttatttgccaaggtaactagggtgctgcgtactatgtgatagcctggttacatggaacccctagggaaatatctcgtttttatgataaaaatttctttagttgaaaaatttgtgcatttatttctcaaatcaatgtccaactgttttaataatttctcatatgcagcttaagattaaaattcttcatagagggccttttattttagaatatggtctttccttggtatctatggaggactgattctgggaccccctccccatggataccaaaatcaatgaatgctcaagtccctgatagaatgtatttgcctaaaacctatgcatatcctcccttatactttaaatcatgtctagattacttataatacctgatatagtataaatgttatgtaaatagttgttatactatattgtttagcgaatagtggcaagaaagtctgtacatgttcagtacagatgcattttttttcaaatatttttgatccatggttggttgaatccacagatgtggaacccatggacacggaaaatgtactgtgctgcgggaaagtagtaatatcaggtgtgatgggggtggaggtagatagtatctagactagaggtttccaaactttttcagtcatagcatctttagtgtctcaaaaattttcatggtgcctcctagaccaaaagaaaaacctaaccattccatttattaagtacttaggtctaaacaactatttatgttctactaatttagtggctgtttgagaaaatattacatataaattgtgaggaaaaaactcattttattcttctaaaagcataattacttatcaatatgtgtgtagctatggggcactgcacagctttcacacgttgaattcagattgtgcacacacttcctttcctgttcagttttcattttctcttgttacttgcttttatcacagcaactgctaaaaaaacagtttcgcaaaggtaagatgttatggaaaggaaatgttgcgtgactcagggtagaaacttgaaccacctcaggctagtggcttgtgcggtctctgattttgagtcttgttgcttcctttggaaataatcccatagcttccattcatttcactgtagtgcttgggggtgccttggcactcaatttgagaaccacagatctagacatttctatttagttcattatttggctgttagctaaacatccattgtgtttatggcaccagaaatttttatgtctgtgtgtgagaagctctcaaagccattatgttaaagaaactaagatgctccagcactttacccctcccttctttgaattaggttgtatcatattctggtactgaatagctaaagtttattgaacacttatgtcaggcactgagcttgatgaaacactttgcatgtgttctctcattttctttttgattttcataacaatcctgctatataaagcttcttctatcaggctcctcctgaaatccgcttggagtagatactgtccttattttacagatgaggagactaaagttcaagtaatttaagtgatttgcctatgaacatcgagcaagtagtttcagttctgtgatataaacttaaattttcttattttacctgaagactagaatctttgtctgcagccacagcctcttctgtggacactgtgctaccgtccatgtgtctactactgttttgataggtactttttgtgtttcgtggtggtcctaacagggagatctttttgttctcattttcaaatagaaacaccgagactcagagaaatttagttacttgccagagtgaacagctagtaattggaatttgaacccaggtatgagtaattccaaaggttgtaattgtaatttattgtgatgaccagaagacgttttctaaaattctggagttatttcagagtcattaaagaaagattaagttacgataatatggcttttgtgttaatttgataaatcgtattcacttagaaatcatgcatggtatgtgtggcacctctctattaaacagtgtgcctgttgcccaaccatgtgcaataacagagaatatattgtgcttatcatttataaatatatgtatagaagagagagacaatgaatggacctatttgtcagtgggcagctgactgggatggaacactgcagcaacgctgaaacgacagacccccgagataggatggtgtgtggaggatcagattttaaaggcttgtttagggaggtgtgtaagtgctaagtagtttctcaagttgaaaattaggaatctcttgatcctgtcacttctctataaaacctaataatcaaacagggattcatttgcacttggagttgcatttccctctggaagaagacagatctaaatcagaggtatgcttcaagttggcaaacactttgggtgggaagcaacattaggtactggatgaagtgcgttgcattagccctgggctccttaggacttgaggtgtaatttgcagaaggatagattggttcatgtgagttagctatggttcatctcttgagtgatgggggcggagttgttatagaatgtaagaatgcaaagattgaatggtcaatgtggtattttggcattcttccaaatccttgtagctcttttggagaagcataacactgctttgtaggaaagagaaaagtgtttacatccagaacatattgagtgggtgtactgagttcagcagccagggtcgtgtcccccaggcctactgttgtggtttacccagctgagacgcacagagggtcaatacagtcagatttctgcatcctgccaccccccgcccattttcatctctgtcttgcatgcatgcttgctttttcctttttcttgcccacaaccaagtccagcacttaaaatggaatagtgcacactctagggcctgcttcccagaaattctttgtctgtaaatgtaggtgtgcgcccaccctggaaaatgctttcttcttattgccttgcttggtgcatgcagtgcacatgtcaccatgcttccttgttttaggctgaaaccagaccacacacttgggtagcactttacacctagaatgtaccactgtggtgtgagaatataaaaccaggcataactcaaatgacatggattttatttcacatgaacctttttatctccaaatagacaaacattgaaaaccttatgccccaacaagaaagaggtacttcttattgaggtatctaagggtacctgtttataatatgatttagttcagccatatttaataaataatctattatttaatgttatagttgttgtgcattgtatgtataaattctaaatttccatgtaccacacatcagaattaattttattatgggattttttttttttgctcaactcataactgttagatgtgtattgtgtatctgtccatgttctgagtattatagaaagcatccaaatatgccagagaactttccctctcattggataaaaagtgtacacatgtgaaatggcaaccaatacggtcacatttggtcccttgaacaagtgctattagagataatacaaagaaaaggtcaccccaaacatggtatatagaagactcaggtcttgggttgagatgtaagtttgatggagagaaggtgagtgggatggtaggagaggcaggtcaggtccaggcctggagtataagagaaggtatatctgtactctggaccttttttttttttttttttttttttttgagagagggtcttcctctgttgcccaggctggagtgcagtggcacaatcatgggtcaatgcagcctcgagctcatggctcaagtgatcctcctgccccagcctcctgagtagctgggactataagcacatgcagccacacctggccaattaaaaaagtttctctttgtagagatgggatctcactatgttgcccaggctggtctccaactcctgggcccaaatgatcctcccaccttagccttccaaagtactgggattataggcatgagccatgatgctcggcctatctggagcttttaaatatatatttttaactttacagagttgaagtaaactctgttagtatttgtataatatttaacaaccacgtacaaatagataatgactaaatttgacacttgcttttctgttcctaattacttatttgtttaaaaggagattaaagatcttggagcagaatgccttttgtttattgaaatgcagcttgtttggctgagcagaattctgttagacaataattatgcaccatctgaatacaagatactttattggggtactgtggctgtaaagaggactaacaaattatttttccttccagggacttggagttttgtaaggatagaaagagaagtcagtaaaatagaatgtgattggtggtcccctcaaaaagatcttgatgttgttgagttgctcttatgtcagttgttttgggaattcttctatttttatgacatcttaaggagtttagcagtttaaaaaattatgaaagtgttcccttagacattatgtgtgaattaacttgttgattgttggtgttgaccataaaaataccagcaacgttaaagtattactttaataccaggatgtcgtacacacagatgcaaacacttacttcatggtcttttccgctaccacgaggggtgagagccaaaagctaagtggcaggctaaaggagtgcaaagaaggagaaaactaagagcagaaaaattaatccacttgtcatacaccagaaggcctgccacgcaagactttccagctttcctgcctatcttggctgggcttgtctggagagacactgtgggtttctggaaatgagaccatcaagactgataaacacgtgttgtggtgaaaccttaagttgtctcagtgttactgtgtgtttggatagggcagaactttacttcagaacatggctccttcatgagttgatagttttatttttaatttttttggtaatttaatcttaggacatcataacttcaggtatctgagtctctgtttttaattcctttgtatatatacctcattgcagaaatgtagggtcctctgttgagtgtgtggtcaacattttcaggaaccaccacactgatttccatagtaggtgtaccattttatattcccaataacaataaacaaaggtaccagtttttccaaatccctgccaacacttattccgcccccaccttttgaaattactctttcacttttaaggaccctgtgattataactggttcccaccaaggtaatccaggataatcttcccatcgcaaggttcttaatcatatctgcaaatcacattttaatatgtaaggaaaattcacaggttcctgggatagagatgaggaaatctttgggggccattattctgcctatgacagcaagtctacctttgaagttgcagctgtttgcaaatgagaagccatgaatttgaggctataattttgatcatggttatggcaaaaatattcatttttaagacaaaagcataatctttctcttgttatttcagaagacgtgaccttagttgaacataaacttgaactcttttcctcctttggtgatccccatcataagattgaatagtatgaggctgtaacctgggccaagcttgagtatagaatccaggttcagtaatcgtttccagagtgactgctgtgaaagagaagagggagactagcgataatcttaatgtcctgagaagggaattacagatatgttgctgggaaagggctgggggagagtgaggccagggttccagggcagtgggacaggtgaaattatatactgcttcagatcagcaggtgatacagactgcagtctcatggctttcttgtggtagaatcttgatatctaatatgttacaatttgagtttggtatcttcagttatcaaattgagtttactcttcagatcttatcacatagaaagttgacattcaacagcagaataagaacactttctctggatttcgatgcattttggtctgtgccagcaagcctagtaccttaatatatttggcctcatgttgtctaatcattgcccatgaaggagttttctagcatctcaagtgtggcctcttgtgtaactccctcattcagcacacaaatgtgtggattcagacacagctcctggcacagcagttagcagacagtaggtgaagagttctttgaaatccagaacatgtcaagaatcgttagacagcagacctctaatgaaaatcagacatgaagtttgaaaaaaattgcatgagtgattctttccattattctctttgtgtttaaatgcaataggaatctgtattttaggggctggcactttggccagaggagggatgtgtggtttttccatctattagatgttgaatcactaagccaatgatatggggagtagtaggaagatgggctgcgggagagcttgtccttgactgctatagctgcacccttttgtcctgtggacaagattggctctcccacctagcttggtctgtattgatgataatctggccttgcaattaaataaataccataaacataaatatgtacatagtgagctccttttttaatgaactcctgtttatttgcatttaaaaaggatggcaacagtgtgactactttaaaacagtagataattcacatgagatttagggaattcatttttgtctgttaggttgtgttcactggtttaaaaaatggataattttctagaggttcataaattaacaaaatgggttgttttatgtggatggagcccaaaatcaaggaggaatgaagacagtggcaagtgctggcacttctgttctaagaaaactatagtcaggaaaagatggaggtgcattaaagtagcaaatttcaagtgttccaactactttacatgcgttatctgatttgatcttctgaaacttctgtatgtgtattcacacacgtgcacaaacaccctccaacatatgtaagtgatccttctttcatgttaaaagagaaataataagagacatgttggcctgagttctctttaacagcttcattgagatataatggatacagaaaaatggtatattttaaactgcataacctgatgtattgatatacagttttgtgttgcttaacaatggagacaggttctgagaaatacatcattaggcaatttcatcgttgtgtgaacaccacagagaaatgataaccacctagagacatgatcacgagagtcagactaattaatatatccatcatctctcaagttaccgtttcctccttttttagtgtgtgtggtgaggacttaagatttaccctcttagcgaatgttaactatacaatacagtattgttaactagagtcaccatgctgtacattagatcttcagaatttattcatcctgcctaactgaaacttgaccaacatctcttcatgtccccctgagcctgaagtctttgctctaccattggtaataaccagttctgtgaacttggacaaatgctttcacctttttagtctgttttggtcacctataaaagacagaacagaatgaatgtatcacaagcttctcttgtagctctgtactttttgattataaaaaagttatggaggagtcataagaaagcaagccttctaagaaaatagactgtacctaagattgtgattgagagattagaggtatgtctcattaccacagtttccccagaaaggacagctttctagtcagcttttatttccaagatgttactagattagggagagcctaatttctccctttgtgagcttcactggctacggcggtgatattagtaccctcaatgattcaataaaaataacagtgacaatgaaaaatgactgactggtgattcactttggggaactatttggctggctgcctgagacctgtgccaggaaagaagctgaatagattttagcagcatcctctaggctaggaagataataaaatttaggatgccaggtagttgtttggaccatgaatataggtcatggaaggaaatggattttaggtgaggggaattgatgggcaggccatgtgctgaatttgcagccaccctgctgaggccctcagctgttgtaattttcaagtgaactcaggagaattggtacattactcagttccaagtgacttaatttgatgtcccaataatggtataaggaaaaatgtcaatgtaggaagagttaacagagcaggaggaatcatttacctcatttgatttgaagaccccttgaagacttttcctagatatttctttggccgatgacttctcactgccatagagtaagtttgaaattatctggtttgatgtccacatgaacttggtctcacgctacccactccttacctcctggtttattctgtgtgatgcacagctctttgccttctcctgtgttcatgcctttgttcatatctttccttttacctaaaataatgaggataatatgaataatatcatttaacatactgagtactttccgtgtacttacttttgtactattttatagtaatcctcccatatccgtgggggatacttgtcaagaccctcagtggatatctggaaccttaaatagtactgaaactaatatatactattgtttttcctacatatacatacctatgataaagtttaatttataaattgggcacagtgagaaattagcaataagtaatcataaaatagaactattgtaacaatatactataataaaagtttatgtgaatgtgttctctctctctctcacaaaatatcttattgttctccacgaacctattttggggccatggttgaactcagggaactgaaatagcgaaataacagaaagcaaaatcatagatgtgggtgaggctactgtacatacattatcgaatttaattttgcccaaactctatgatgcaggtagtaacattaccaccatcctcatcaccctcatgatgcttatcactaccatggtgatcatttccatgtcacaagtgaggaagctgagatttagtataaataacttagctgagatgacactctaaatgagtggtagtcatgattgcagcccaggtggcccatctccaaagcccacacattagaaaccatattgtgtcatttaatgccattctttaccatcctccccacacatccaggctcaatgcatagtattttctactttccgtagcaaaaagtaatggctccttctctgaggttctgtcggattatttgacatgctccgttttatatttgtgtattcatcttctttccttctgcttcattgatgccttgtcaaagcctgagtttaccatgtatttgtatcctcaccttgatttgttatttggcagagtttattaagtatatattgatttgacactgtaccttgctatctgtattcagcccagtcagttttttggctccagtttatatttttcaacatcttaaaatacttcaattaaaatgccagtatcttatatgaaaatattaatatcatgcatttccaccttcacttttcgtgctaatgactgtgtctggttatttaagtggaattgtgagattgcttagttcaaataagtcatattttagaaacattgtagtttaaatgtcatggaagggggatgatcatacagacctctattctgagtcctggctttgccacctacctcatgcatggaggaattacttaacctccttgtcctccgatttccttctctgttaaatagaaaagataataactacttgtcaggattataagacagactaaattggataatgcatgcaaagagcctaagtgcctgagacataccagtccgtcaataaatggtacatcttgttgtttttgacccttgatttcgattcttcagttttgaattacatttactggctttttcgactgtggggtgtttactaatttcatttgctttaggattcaaatagtgtggtttaagatcacccgtaattagtagagtcaggattagaatctagctagtctaattccagagcccaactagcaaaaactaataaatgagtaaatccttgcttgcaccgtctcattagaattcattgtgctacccagccatccagttgaaatccatcccatttccttttttgtagcgacaagtaatggctccggggaagggaacatggggagttgttgtttgatgggtacagagtttgttttgcaaaatggaaaagttctagagatccgttgcacaataatattaatatagttataaacactacttaaagtataaacttaaaaatggttatgaggtaaattttatattatgttttctaccataactgaaaaattttttaaagtaatgactccttcttttgagttcctgtaaacctctgtatctctattatttaagagctctaaaagattgtctaagccatttcttttgtgacatgattttccctgcttccataagaagcactacttgcaaagtccatgttttttctctctaagcaagtggttatatagtagaagagttcctgttataaaatctggtgactgaatgcttgtgagttttaatttagagattacaaggacaaagatatattacataaggtgtatttcatactgttcaatttccctcctgtgtgtctccatatcactgtgggtttctaagtatgagccttgagaatatttgggtaaaagaaggattttacaagtttgcattaataccatgaaaccaggtcaggagctgatatcagaaaactctgttttgctaccacataggtctatttggttgtgaatgatttgggcaccatcattctgttctgtgttgtgtatgataatctgtgggtataacttgagatgtataggctaccatagattcttcttcaccataattactttctttataaagtactcaggaattttgggatattctatttttctttattttctagttataatttctattttcaaaaggttctgagatggaaaacacatttaaaagcaaattaagattgtacaattatggataaaaaccaaagtagagaccatacatgtaactaccacttggaatagataccaatctgaattaactggcactgaaacaaagttcagattcatggtttcatggtttattgtatgtggcagaagacgctcatttttcttttcaggaaaatattgctagaattgaagatttttttcccccgtgagttttttttggaaaataataagcaacagatattatcatggaatgatgttttacaagaaactgaaatactgttcagtgtgtagacattgttaatagctataatataaatcctaattcattaaggatatttgcaggctgggcagtatggctgattttgtttgctcttcagtattcaacaacctgcttaatgcctaccgtttgccatactgtgccatacgttgatggttaagaagaacatcaaaaattgttcttgaagcactcagtccagtgggaaatttaggtaagcatacagattgttagggtacagtgtactaggtgttatattagagacatgtaaacagtgctgttagagcccaatgagagggtatgtcttcctggagtagtggggggaaggttctaatgataaatgacatttgaattgattcttacagtttgccaggttgagagtggaaagaaaggaacaattttacagaaataatactcttggatgatctaatttattttagctaggaacttgtacaatctagaaaaacaataattaacatccactgaacttttcaattcaaatatcatatgtcttccatcgacctttggcgatacttgcaggcagttacttggtgattaagttgtctcagatgcctacagtgcggacattctggtatatggttaaagcccaggaaatatgttggatggaacaatggatgaaaagaatgaaaggagagccctatgtcacagatgtcactaagagtgggtgaggtagagttgtcaccgtgttaggaagactcggaaattgattgatattttcagccaaatagatgagcagtccatttttataaaggcagcaaagggacctggagatagagccaatattttcctcacacagtaacttggactcatgaattacctgctcaaacatttagcttggactccagagtcttgccctgaacagcacaagaggaatgagttcactcgaaagaagtttaaaggcagttattaccagctaatcacaacatccctgaactttaaccagacctctgtagagtgtctgattttaaatagaactgcttcctcatggtccttatggaattattaagctgtacaatgtatgtctgagtagctcagaggcttggctcatggaaggggttattttagatgcttggtgaatgattacccagtggagctttagtttggatgtattgatgttgcactgctacttctgacaataactaatcatgctcaaaaagacttcttaagtctcttcttgttcagagattcagacctttcttttgacctccagaatcatgtatctacctgcccacttgagtgctctcttggttatctcatagctatctcaggcctaaacagggtcatttataaatcttattcttcaccaactcctccagatttattttgccttttgttacgtgcccctcttattaactgtaccccattcacttagtgactcaagctggaaacaaggtacaaatcctccccagcccttaagtctaaccagtcagtttcacttaatatttctgacatttgtccacctttcttcattcaacgtgccatcgaccccatctaagctgccatcattcacttgaactgcttagtcctggcctcctactggctctctgcttttgctgtttctaatctgttctcctcatagcacctattgttatctttgaaaaacaacgtcattatgttatttatctgcttaaaagccttcaatggcttcccgtggcacttcagataaaatatattgaccctggtctgcatgtctaggcatgatatggctttgactcacatttccaacttcatctttttctcattccttctcttttactttctctctggctgttctgacttttttcagctccttaaatgtggaaagctaattcctgcctttgaggcttcccttgttcactgtgcccagtgtgctttcgtccgccctctgcctggccaatccttctcatttattgggactcatttgttactttttcctgagaggtttttccagactgtctaatctaagactaccctctgataacctttctcaagccttaccagagtttaaaaagctttgtttgtttcatatgtgtctccccaccataacacagtgctctctgggcatcgcgtctgtttggattcccaccgtgccacccagcatgttgcacagggcttgtacaggggcagtgctccataaacatttgttgaacgaaagactctttaatcaaaataagagttagtctggaaggggcatcttgcctttctctttgcagaaaacgacagagcctgtgtgtaattcctgtggcgatgtttgccaagtgcttccacgggaatgtctagtagagtactaatagaaggtcataagctattgccgttttgctctcctgcaaaaaaagcttggtggcatattcagaatttatccttgggagcctaacagactaagtttaggtcctgtctttgttcctgtaaagctgtgcaaccttgagcaagttaaccaaattctcccgggtctatttccctatgttaaatggagaagattatgtctatcccacatgcttattatgagtattaactgagattacatatgcaaagtgttgaatggagtacttggcaccttgtaggagttcaggcattctttttcttattccctttatatctcgagattagtgaggactcaagaggaaaagaactcatttaatttataatcttattgttcttacttaatgcataattatagctggggtgctaacatgaaggtcaacaccagtttaagaggaaaacctccttctctggagtgcaaataagcaatgatggactgaccatttaccagtaaataacattagacttcctcagaaagatacacatgaaattctcctttgccttatcccaggagtttttttttaacattgtcaaattgtaataactaataattacaaatagactttttccattgtagttcaagtagatattccatgaagacaggccatatgaaaacattttcccatattagatgtttctatatctaagaagctttggcagtaccattgaaaactctttataaagtccaaagctcttcaaagtaattgtcagctttgagggggggtgattaaaatattaaatattttaggccaggcatggtggctcacgcctgtaatccccgcactttgggaggccgaggcgggcggatcatccaggggtcaggagttcaagaccagcctggccaacatggtgaaaccccgtctctattaagaatacaaaaattagccagacatggtggcaagctcctgtaatcccagctacttaggaggctgaggcaggacaattgcttgaacccaggaagcggaggttgcagtgagccgagatcgtgctattgtactacagcctgggcaacaggagtgaaaccccatctcaaaaaaaaaaaaaaattaaattaaatattttaaagacaggttattgtaaaatctgatggattagactcaaataggtggcagatatacttaaggcataccaatctagatgttagattgagtttaagggaaaatgcttggtttaatttatcataatcagtggttgattttctatcattaagtcaggacagcatactcacctttgcctctgttaaacttgtttcaccctataacacaagacaataaccatgaccaggggaattgtttctccctaagccaagtccttcagagagctaggagcttgagtattaaaagttcaagacctttgcatttgtctgcttgaatattgacccagataagggactacattgtttatttaggaataggtgtgacttagagtgctgatgccaggggatagacaggatgataaataggtataatactttaattgactacttagctcagttgtttagcacatgagaactttggggaggccaaaagaatagatctgaattctttctgaggctctcttactctgccatggtcttttgccaaagacctcactttgcatccaaacctagtatcttaaaaatgtgtatgattggtcatttgggacattagattcatgacatgtgaaagtacctgggaaaaaatccatgaccagcactacagaaggtgtgctgtgttaagaggagggtttatacgagtgctgatgtctggacatctcttttgcctcatgattaatttcctactgcaaactcaccttcataaaccaatatagctcaactgagaattgtggttattaatgttgacataaatgttaacatatgtcctcaaggaatactgtcatctcacagaggggacaaaaaatagttgcattgttgtcttttttttttttaattcttttcctcatagttgtttatcaaagtgagtataatttgaatctatcagtgattctgatcattgtgttctcttttggtgttttctgttttgtgtctggtggggctacagtgctttacaaagaaattggataccttgtgacctttttgttgagtagaaagggagtctgccaaagcgacaaggcatcacctttgctaaaatgcaagtctgattgttcaaagcagatcatctcacatgtcccaccatagaacttcagaatttcccgcctctcatctaaccgatttgatgtttaagtgacttctgtgggtgttttggtttaatcagatactaggaattgagagaaagtcatgaaaaaaccatagtggtattatttggtctgcctgcaagttaccaatttggaagcctgctgtggaatgtgacatcttttctctctttattttttttaaacagaatgctatgaacctacctcctgacaaagccaggttactgcggcagtatgataatgagaaaaaatgggaactgatttgtgatcaggtaagaaacagtgacactttcttttatgaaaaaagtaatgaaagaagagatccagtgtgaattttatggtatgtcaatatcatgattgaaaaacaagatatttgcttctgcgacagagataggaaaaaagaagagaacttcagagaaataacaatatgtttgtgtggatcttctttggatcccagtttgaacaagctaattattaaaaagacttcttgagaaaattgggaatatttgattagtgactgagatgcttccaagaaattattgttgattttgtttgatcgtaaagtacatagaataatactgggcacatagtaggtgcctctaaacttgtgtggctgcctctgttgctgctgaagggcccagatattaaatattgtgactgttactgtttttattttcaacttgtccttaaaagattcagagaaagttatatcaagttgatatggtttggctgtgtccccactcaaatctcatcttgaattcccacatgttatgagaggaacccggtgggaggtaattgaattatgggggcaggtctttcctatgctgttcttgtggtagtgagtaagtctcatgagatctgatggttatcataagggggcgtttccctgcacaaactctttgctcttttctgcctccatatgagacatgcctttcaccttccgccatgattgtgaggcttccccagccacatggaactgtgagttctccattaaatatctttcctttgaaaattgcccagtctcaggtatgtctttatcagcagtgcaaaaacagactaatagacaaatatatcattatctgttatccaaacatactttatggtttgaatagctgttatatgatgctgtcagaaaaagcctcagctatagatttccagtctaaaaatattactaccaaccttatttgtgaagccttaaaattatgactgtggggtggtgttgatatccaacatacaggacacccccgggccccaatgccgtgtgcacgcaaatattaatacaaatattaattttacttcttggatacaaatattaattttacttaagcatatagcatggatatagtatatgttatttaggatacatgttaacaggaaaggtacacaaagtgatagataatgttaaagaaattgatttccaaaagaaactatataaataagagtgtgaggacttatggagaaattatttcaggtttcagtttcatgaaaaattaccatatggacatggtgaatcatggaactggtcattgttttccttggctgctaagatgctcagagacagatttgtggcctgagccacaaatttggtataaatgcttataagagaccatttataccaactacacagtacttcaatgacatgtgttttaccaacctcatccatggcttcatctcattattcctgcctgcattttccctccacactgatatcctcactgaaaaaaacttacatgaagttgtaaacttttgtaaattatcattttgaacaagatatatttaaatatatcagcattactggtgaacaaagattattcttgcattgataactaaactgaaatgttctctatgctataggcattgtacaaattagtgcattgaatctgttctgcttctctctaaggaagcaaatatggagtgtcacaataaatgctttctcatgacttgactttatcatgaagtggccgttcattatttaatttggggcatccattttttcatacttctgtatgattgcattagtctatcactttgttttgtaagtatttatttaagtgtgtctccctcaagagtaagttcctttaggatatgggcctctaacaacttgcttagtgcttgaaacgtgcttattgaaaacatgttgaatgaaagaaataatggctaatatggaagacagtggagaggaagcttgcattattggcagagagggcagaagggaaaaagcagttgaaagaggtggcctggaagactaagcagaagtttgctgtttccatatccttctcaccttcctctacctgtcagtgtggtttgcttttggtaaaggaaagcaattcactgctcatttttaggaattactttaaagagagaaggataacatttttaaatgtaataattcagtggtactaaatacattcatgttgaagataaatatttcttaatatgacagatgctgataggaatagagaataaattccagaaattctgtcccaaatttaaccaaattaagattaaatcccaaagagctttctatagtaacaatattgcagaaatgcctcttggtcctttcctgactcattgcataaatacaaagatgacctgagcttctagtgggtctcaaaggtgaaagtaacatgggagacgtgtctaactaattctggagggagtggggctacggaagccacggaacagagacatctgtgctggattttgggtgcagtgaggtgtatcccagcgtacccatttctgtgttatagtaggtgaacagagttcccatgaagacattattaatttaaggactctgtggggacacagaggcaaattttgtagtgtgagcgtagaaagctagaaatgtcaggtttctttgataactgcaaataaaacccctgaagctacttagctgtaagagctctttcagtggcatttacacttatggaaagagagaaagccccttaatctcacttgtgcctcagtttttggtgcagaccctgtgctgcacgttttggttttggagctttggccatttcccgtaagtttagaactcttagcacagtgggtactgtggataaatgctggtttagggggtttagagatcctggatgaatttagacttttagatcatttatatctagaagggctgttagagaccatttatcccaagccactctgactttactttttctattgaaaaagttaacacatgcttgtccaagaaagcttgtggaggagcatgtggagtgaagtgcgcgtcccttcgcctttcctatctgtttcccaagccccttattttatagatgatgaaactgaggttcatagagcctaaatgagtaggccaatgccaaggtcacccagatagtgaaacgagaacatctgtttccaaactctactcacaagctttttcatttgttgcctgttataccagggatctggaaacaagccattgaagcaaaaattatagtaggtaagggtttcttaccgaagttttgtgtgtggctgctcaaatgatttagggggtgcctacagaacttacaggttgtggattcataactgtgcccctgctggatgatcaagtggaagtggttagtcaaagaattcaggacattggagatgactaatgcagatgggtgtagattccaccaacatataatccagtccagaagctgttagaggtgccatccctatgctgggttataaaagcttccttctgtgtttgctgttgctgagggtgtgattggttattttctgtggtgatttggcatgagtggaccttgcctcctgatagctggctgttgctttgcatagtagccttggggcaagggcccaacggaagggtgagacatggaaaatctcccctttctttacttatataaagcgatggagagaagcagattaaaaaacaaaacaaaagatgagcgtgaagaggtagcaggaaattgtagccacttagactcagcttcctgtgcgaagcgtttcagggaggtcagactgcatctctccaggcttggcatgggtcctgatctagggaaggggaagccctctgctgccactcagccggagcagagtcaggccagtggcactaagaagcctcattactctcattgtgagaggtgatctcttgtctttttcaacacagctgacccataccatatacatgtatttaatcattaagaatataattttttttaaaccctttacttgtggtcaaatactatttctttaaaaaagaagggcaggttttttactggagaacgtgcatcaatatttaagccaatttgccattggaattaaattttctaaaacattaaagagcaaatatatctccatggtttttagtgttggttattttttttgaaagtgttcatgtttttgtgagccagttaaagctctttcctgcctagtaaacaagtactacagaatcctgataaattagttcctgtgggccattccaggtaaggaggacttgtccttggagcaccaggggtgctaaatgagtagtgacagtggtggcatttttatagcctattttgatgttggtggctgctatgttagagtcatttgagcaagcataggaagagcagagacagtggtgaagaagctgaaggaaaagatggtgatgccagcaataacctttccctggccctttccctcctttttgctcctagacttcagacttagtctgccttttagccctgtttcccaagttccaggctttgattctacatttagctatgctcactcctttctggcttctcactcccagctgttgggatagcagacagccatttctccctctccttctcctcccttccttctatcctctggctaactgacatgcttcctgtacttaatatgttaaattggttatatttttatcaagtttacaatactgtggtatgattaaatgctattttaaaattattaggtttttgcgatctgtttaattcttttcaaattttgtcttttgacccttagttttctcttatcattttgatatccagtcttccccctctatacattcattcttttgattgtgcattagtcagattttttgtttggtatttgttttctagttcatcttttttttaaaaaaatcggtatgcaccttataaaatttttctcttgtattcaaataaggtcatcacaattaaaacgaatagtaatttcttaatatctcctgttgtccagtttattgttctcaattttccttaagatgttcttcctatctagtttgctcaaatgataatctggtacaggatcagtcacatattgtatctggccatgtattccttaaattactttaaactggagtagacttttgtttatgatgctcatgtggtgaatatagtaggcaagccctcttgtagaaagttttgttttctgcacttacctgtttcctaggggtgccttagctcctgagtttcctgttaactagaagttagacttgaagtcattacagattgatgttgaacatctttgtgaagaatatcatagaaaaataatgtctggttgtcccatcattaaataagtttggccagtgacaacttgatggccccattgtgtaactgttttccccttgtgctggagagaattctgtttggtgtcactttgtcaccatatatacgtccagttacctatcaaccttgtacctaatgggtttgaaaccaattgataatcttttgttgaatcagtttcattacaaactggaaaaagattattttctaatctctctttccttctattaatacagtaaactagtaactagagctttcaactgggacttggtttatcctggaatataattattcctggaatttttcccctcaattgccatttttttaagtaagaatttggattaatagatacctcataagatgaccagtgggttttctgtggtctccttttttgaatatcactacgaactcatgaattttcatgggttcatcatgtttcaatcaatgtgatattatttttgaggctcatatgatcacttctttgatctatgggaatcccttggtgctggttcttgtgtccttttcacatgaccctcttaatccttgagagcttgttttatggtatgaaacatatcttctttgtatcttaacttgtatcttctttgcccaggcccaggataaatcatttctccaatgatcccttttctttttagtgggaggtagtattagagatgaggaagtgcatgcaaaaggtttttatagctgctgagtgaatttgcttctcagtgtaagtttctagaccttgaaaatacaggtccagaatttatggattcaatattttcaaatcaattttcattaattttcttaatctctttgattttatagttacctttcttttacaatgaaatgtttgattcctaacagtaatataattatttacctttttctatcatataaaaactttcaaaacaaatatgagtatcattactacctaaaacattactaagtaaattactgactgtagtataaggttttttgtagttttctgtgcaccaaatgatagggtaacgaatagatgctatcttagcgtcctacggctgccataacaaattactgcacatttggtggcttacaataacagaaatgtgttctctcatagacctggagaccagaagtctgaaatcaggctgttgactgggccttgttccctcccaaggccctaaaggagatttcttcctttcctctctttccttctggtgtctctgggcattctttggcttgtggctgtgtaaatccaatctctgcctccatccttacctggccttctcctcgtctctgtgtcttttcttgtcttttataagaacagttactggatttagggcctacatggataatctgagatgatcacatcttgagatccttaacttcatggcatctgcaaacacccttttttccacaaatggttatactcactggtggttgggggaggaggttaggacatggccatatcttttgggggccaccattcaacccactacagacactaagatgtataatgattcacatagtaaggttttaatttacataatcaggttggatattgttggccattgggggtcaaattctacacaatcagggacccaggtgaggctattttcaacacacagcttccccttcaccctgggagtcatctctttccagtcaaagggagaaagaacatgcaaatgcacacctgggaagtctgtgggccaggcctggaattggcacatatcacctgcactcttacttgttgacaaggacctgcaaaaaaggatgagaaacggagactagctgagcacccacggggagaagaaaatgtttgttaaacaacgactgctagtctctgccacgattaccaattttgatagtcttatagttcatttgttttaggttgtattcagtattaaaacttgcccttatgtattcattaatttattcattgactaggcatttagttttataggtgagggaaaggaaagagtgaggtgagacatggagtgtggatctgagttttccttataagtcaaggaaaaggctccaaatggttggtagtaccaatttgtttgtcccgagttccagcaatgtaccagacaagaattggctgtgggacgaggttatttttcccacacctcagaagaaaaagaaaggcattttgtatctttgctactttctgcttgagatttcgaagggactcttcattttcttgagctctccaaacctgagaaaaggcactgaattaattgctgttgaaaagaagtcaagtttcttttcatttccttcctaaaagcagtttcctttcctttaagactcactccaggtctctgattctttgattctgaaacactggaaaagcaatcaaatagcagatgccaactctttgtatgttgagcttttggagttttggaaagttgggtctgaacctagaagtgaatttacattacgtctttcctcttctagaggtttcctttggcctatagctttcacatgggagagaaaaatgctggcctaccctacagagattggagtcaggggagagaaaaagggagaaaggtagtgaaaagaggagaggaaacaattatcccttttaaaaccatcctttttggtggcttgatagaaatactctgtcagaaatgctgtttggtattcgttgccagagctagacatcaagggcttagtctcgtttgaaatgtttaggctttagaaggagcaagataagtggggaaggaaaaaaaagaaaagaaacttttaggctgtattttgccaaaatgtatatcacagtgcctgccttcctgcctagcaatacaaatggaattatagatcccccactcccaccccaccttttaaaaatgacttaattgcctgagctggcttagactacgtggttgtcttgtttaaagtaaagtttatcatatgaatgacttttataaacttgaggacactgaggttgatctttgactatcttttagaaaatcattgctaagcaaattaaaatgatttattaaggcaggttagctaagaatttctaccaagtgatacagatactaccttatgtcattttaacatttgactatttaactcatactctttgtttgtagaaggctgttgttgctcacctttcacacacaaacacacacacacacagtcaaagggctttctagaagttgtacagcaagtgcttgagctgaaactaaaactgaagtctactgatgcctgattctgaaaaattttatgtttaaaaaagttttttgagaaaaccaccatacaattgtagcttctccaccatcaagcaattaaataattaacttcaccttgtgaagcgtgatgtgctagatgctaagaccaccacgcttcagaaaatattatgctgaatgtttcaaaacaaggttgaaaaaagatacatacacttaaaagtaaactgtaaaagactaaatatataatggaatgctcttagcccagatacatactgtttcctggttgcctacagtgttcttgatgaactttcaaggaaagaaagagtttaaaagaagtcattttctaaagtcattgaggaaattgaggtgtctacagtctttatccctgctgcagtagtaaaacaacatttatttaggtagcagaaatacaaggtaagttggtttaaatttctaatgatactgtaggtatttgggagtacagcaagactggaggaaaactaattagaaatatggtttgggttttgtaagaaacagctatacatagggcagagactgtgtatatcctccgtcaacatggcggatactagctgtggatgagtccaaggcttgtagcagcatcttcaggtactagaaatatccttatacagatgtttcttaccggtaaaaccactgttggttctcttcacaatcaattggaccacagccacttagttattgatatatgtacccatattttcagatagagtataacttcaagtcagtctaaaaccctataagatgagcacatctaacaggttaggtgtgtgcttatatatttttgtcctcagcaatgacccatttagagggacctcctttctactttccttctctgcctatccttagatcctatttgaaagtttggcttaatgattgattttgaccatgtgggtcacagattgaaactattgtttgcttaatcatgggatctgaagatgaaaagaaagaatgtggggctaatttgaaggggtgtttgtgtttattatgctaaatgtaaaatcaagatgtaagatctttttttttttcttgagacagagtgtcggtctgtcacccaggctggagtacagtggcacgatgtcggatcattgcaacctccccctcccaggttcaagtgattctcctgcctcctgcctcccgagtagctgggactacagccgcctgacaccacgcccagctaatttttgtatatttagtaaagacagggtttcaccatgttggccaggctgcttttgaactcctgacctcaagtgatcccagagtgctgggattacaggcgtgaactactgtacccagcctaagatataagatctaaggggaaggcatacagtgggatcactggagcctgggtttaagatgtaggtcttcatgttattagcacatgttgctttagtttttatgttttagaaggagaatatttatatatctaggagaatgggatgtggtttaggggtgagggtgaggtacagaagttggatcaagctagtgaattaagcaaatatgaaatgacagtgaagtcgtattaatggtttgtggtatggaggtacatttttagcctgactaaaaaattgtggtgcaattaccataatttttaattctttaaatagaattatgaatgatatgtttttgaaatagtaaaactaaggtttataggatcccttggagtactttatttcctgcaaaagtattaattgacaaagatgaatatttggcttgtctctggtgcatttcttcttcattagggcaagataaactttttcaagagagttgtgctcagtaacaaagtaaataaataatatctaaaattactttgatatactgtttttaattatttttattgaggtctaatttatatacaataatgttcaccagttgtgttttccaaagtggctagaccattttgcattcctaccagcgatgtaatagcgtccctgttgctccaaatccaatcaacccttggtattgtcagtccgttaaaattctagccatttttatgggcatatggcagtatcttactgtggttttaatttgcatttccctaatgactaatgatgttgagcatctttttatgtgcctgtttgacatttgtatatctttgttgaaggatctgctctgttcaaatcttttgcctattttaattttttttcttattttttttttttttgagatggagtcttactcttttgcccaggctggagtggagtggcatgatcttggctcattgcaacctccgtttcctgggttcaagcgattctcctgcctcagtctcccgagtagctgggattacaggcatgcaccaccatgcccagctaattttcgtatttttagtagagacagggtttcaccacgttggccaggctggtctcaaactcctgacctcaagtgatccacccgccttggcctcccaaagagctgggattacaggtgtgagccactgcgcctggcctcttttgcctatttttaaaaagtgggttatttgtcttagtgagctgcagaagttttaaacaatattctggatacaagtctttatcaaacagatactttgcaaatatttcattagtttttgtctcactttttagtatttataatagtattttctgaagaacaaaagtttttctgattaaattgaatttattttttaagtggctcttgcattttgtttcctaagaaattttttgtctaccttcaggtcacagagattatctcttatgttttcttctggaaattttacagttttggttcttatgttttagtctataatctattttgatatgtgggatgagttaagggtggagttgtactttttcctcatctgtctatctatcatctgtctgtctatccatccatccatgtatgcttctgtatttatctaactttacctccaactgtttcagcacaatttatttaatagactgctctttttttcatgaactaccttggtatctttgaaaaccaattggccataaacgtgtgggtctatttttgtgttctctattctgttctactcatctatatttttatccttacgccaatatgtctctggtttgattactgtcttgaaatcaggtagtgtcaattctccaactttttttttttttttttttttgctaaattattttggctattctagttcctttgcattttaatataaattttagaatcagcttgtcagtttctaagaaaaaaaaaccttccaggagtttggcagaagatgcactggctctgtagatcaatttcagtagaattgacatttatacaatattgactcttctgatctatgaacatggtactctattgatttaggtgtttttaatatcttgcaggaattttttgacatttctagtagtatacaggtcttacacatattttaaatttatctctaaatgtcatgattttgggtgctattttaagggatatatttttaaaatgtttccaattttttgttcctagaggaatattgtttttgaacaacctcccaccacttcatttatgcctttgtagagagagatggtttatgttatatcatcgtacttaccaaaacccagttttataattaaacactattttatggcttctgtaatagaaacaactgccttggataaaagttgaagttgagtgttttgagcttggttcttatgtttaaatctgtgcctaaattaaataaaagcaagtggtaagggtaggatgattaagatctgatgaatttctcttattttcaattattatgttcacaagcatgctttctttgcatgtatcagacccttcgcaccacttattgattttagtggaaagcagcttctttagctcctcccatgctacttgctttaaagtttcactgacaataaaaccgcctcagtgaatattccagttcagtttgattcagctagcacctattgaagttatgataattatacccacaatttgtacactgtttgaattgaggccaatggagtttcagataagccaattaatttaactgtagtcagaaaagcaattcttaaaatcggagcttgtaatttaaaaaaattcttgagtaattgaaaatattagtgctcttgaattgcctaatggtttctacaagaactcttaaggcttattttgtcttttttttttttttttttcctgatcagattttgaactctgttctctcccaacccctaatgttttatttgtatgatacatgaccatctctggggactctgaaagatcatctgtactttctttttgtttgaaaggcattcctaagtaagaggagtaggattaaagaaacctactcaatattacgtattagaaaatgagttataggatgttttggtcaggaaagactcattgaactagaataaattctcgctagtctaaataaaagaaagcatttggaaaagtctcatcagaggttattttcagtctgagagctgtaatggaacacttggaaagttgtcctttcctcttcaactagcaaaatgatttcatattcagagctgaagaatgttttgaggctctccaagaaactatggctgtggaatgaatctgtcgtgctgattttcaagtccagtctagcgcagaaatggccaactttaaaagttgggaacggaggaaagaggtacacagtattaatcatgcacgttttcactattcaagactccttgttgtctgtcctgtattcctaacctattatttgacatccactgtcgtttgttctgacttaccatttagatcctttgtgcaattttcataaactggattactagaactcagctaaacctcttgaagttactaccacatatccctcctttctctgcttttgttcccatgttcctgatctggaaaactcctctgtctcctgcctcttatactgtcccaggatatctgtgcactgcctgccttccaaaattcaattcaaaagccactttctccagggaggttcctttgatcatctcagttgggaagagcctcacctttctttgaactttgagaggatcacatatggctcttatcatattctactttgtattacaactatgtctgttgcatctcagagatgagatttaatactttgcaattgaatttatttctttttgtgctttttacagtgtcttctgtaatgtgttctggataggtgaaagagtaaaaagccttttttaaagttttcgtgttagtgcctggaaacaggggatccaaacatgttagtaagatttaaaatgttcagaggcaggggcttgtttagcaagatgttttcatccaataatgaccactgggatccctctaaatagtagcccagctggcactagcttcctctggtagtcattatacaaattagaatctcatctgaacttgccttcttggccatctattatagtcagtaggcagagacttaatactttttcattttctgtcaattgtcctctcctatctcaccatccccaacatgctcatacgcatactttctgtagatggggaagtccgccagctactctgaaatttcagaatttttattttgggggaaacaatgagcatgcattcttttggggactttggttctctcagttctttgggaatccaggtctatttgtgtaaatcattttttatttgtataaatggttagccctgggagggcaaggtgttagggcttacctcaggccctcctgtttagggatgctgattggtcttggcaaccctctcccctcttctagcccaccctgcaccacgcaggtgcactgttcttggcctcttccgtgttggataaatcatttctgtccatatacaatattattgcaacattttattttcatcttttcctctccctgttacttgtgtcagcattatctattttagagggtaaaacccttgaggatatgaattatgtctgtcagcttaactctgaagagtacttagcactaagctaaatcttacaaattagtacttactaatagcaatagtgctggttgtaatattggctcatttagagactgcagtttgcctactcagcctttggaaaggatgcccaactacttccagcttccaggaagaaaacattcaagtgtagtgacattatgtgaacaaaaacaacgccctttaaattgttactatctaaaatgaattattttaggatcaagataataaaacattaatactcacataatgatggtgacatctaattcatccctgaggatgttcaagcagtttatgtagctctgctaatacaccactgaaatagagccagtgactgtgtggctataccaaacgggagagaaactcaacagtgtgtgccctgagagccattcatcccctgagatttctattttcagatgtcatgttataatttctttccttaagcctcagaatatgaaggtataagataaactggaatggaattcttgtttgattgtgtatccaaatgtgatttatggagcggaaatgcttataacatgcttgttctgagtctagctcacaccaaattaaccccaattaatttctcatgtaattggatagagaggatgtaaaagatcagaaatgctaagctagatgagtggaatgtccaaatttcaaacctttacacagaaaggctttcaatgacaaactctattagatttaagtggagaaagaggaggaggacatgtagggagaggacgaaccaaagaaacagttcagcttgttagaaagaacttaagtctgcctgcctgtgtctagtagaaaaggctatgttgtagcatagctgatgaattctgtttgctgtgacttacctaattaatttactacacccctgtcacagcccgtcacttagttcttttcacaatggtctagtttcccaccttgggttgcagtagacttggtcattaagtggagtccaataagtgttttgttttttccttgtctgcaaggcaggtatgtgtataggcagcctaacgttccaggcaaccagtagggaaagaggaagctaacatacgccttaggggattgggttaatgaggaaacgtatggttatgaaaggcattagacggctttagatctacgagagacacagctgcggctcatcagcaaatgttctttggctctgacgtgagcttgactaacttatgtctactgaacctgctggggtacatcctgtagagtgtgcttatagtctctttgtttacttttacatttaaaagttacccttaatttatgaaagaagtgacttgtatgtgacatttttaaaaagtttaattctttgaacattgttgaagatcaactgtgtgccaagtattcttttacatactgggactcaatgaagaatagaacatgtttccaccctttaaaaaatgtttatactattaaattcaagatgagcatgcttattatagtgtagtaaaatgaacaagcatcagaaaaagtcagaaaactgtgtttgaacaacagaaacattgggaaaatacatcagagaccttacacatacacacacacacacacagtatatgatttcaggtaagtcatttaatctttaagcctcagttccctcatctgcaaaatggagataatatctacttgccagatatagaagcttgagtgagctaagaggtctaaagaatgtgataaactgtgaagtatcactgaaagataagttaaaaatcagagaaacaaaaagtactgccccacatgaaaagttaattgtatttgaaatatctcactaaaagatatttgaagaatcatctacatgatggattgcacgtagctgctaaaggcaaggagttacgaattacattacttctaaattaaccagttcagggaagaggaagaggaggattaaaattcattatctggaatattttatatgaggttttttttttttgtttgtttgttttttgagatggagactctgtcgcccagactggactgcagtggcatgatctcagttcactgcaagccccacctcctgggttcaagtaatcctcctgtctcagcctcccaagtagctgggattacaggcacgcgccaccacgcctgactaatttttgtatttttagtagaggtggggtttcaccacgttggccaggctggtctcaatctcctgaccacaggtgatccacctgcctcagcctcccaaagtgctgggattacaggcgtgagccactgcacccagctgtatttttatgagttcttaaataaaactcatataaaactttcatgggaaccatgaaagaaggagagagggagagggagaagagaaaagaaaactcggcctacatccagggacccaaataaaagtgttatggaggaagaatacaaagccccaactgtttttgtaaaacttggggttgcctgtctaatatctaaaggaaccactgtttgagttataaattcagcacctgatttgccaaaccttttctctctgtttcaatgtggccaatttgaacaacagaaacattgggaaaatacataagaaaatttcagcaccttgccaaacacatttattttgaaggacttcagatggattatgggcatcctatttatttgaattaatatatttttccctctaaatattagaattttagatattgtattaaaagtcgaaactgctttggttggcagtcttccattacccacacttttaaaactgcttcatatcccatgttattttcaggacctcgttgcctgcttgcttgacatcaatgatataagtacctttattaagttaccaacttgagttgcactgtgtagaaatgttattctttagtcatgatgagctatcaaaatgaattgaaaaggcacctccaaagtcttggtgatcttgctccttttgatagttaccacccctccattgagattcccagcttttctgttcattttgatcctcttgcaaaaagcactcaaaattggcagcttccatgactccatcttctagagggtgggtggaatcaagagtgaacttcagaaccttctttttctgtcttccttctccccatttgccacaagctttttcacgggttccatggcagcagtggaggtagaaagaggagatgggcagactatgccaaggcaaatggccccacctgagttttcttagaagtggatgcaatgtggaccaactgtgttttaaagcatgaggcttccttattttctctttcttaatacatcagtaagctgctcaaacaaatgaagaatatgtggaatacaacgacaaatgctaaataagcatatttgaaaaagtgtgagtttattacatgtagaccttgttcataatttcaagtcctaaggaaatatagtccagtcaacaggaccagcaaatgtatgtatttgagtaagccttctgagtcgccacagtcccaaataggaaatgaaaaaaagctgcctttactgactgtcaaagatagggctcactaaatgagtgaatgctactgcgttacatgtgctactccaccaaattttattattgtaaaaataaaattgagcccaggagttcaataccagcctgggcaacatggtgagaccttgtctttagaaaattagctgggcgtggttgcctgcacctatagatccaacttcttaggaggtggaattaggaggattgcttgaacctgggaagtcgaggctgcagtgagctgtgattgtgccactgcattccagcctgggtgacagagtgagactctctcaaaaaaattttttttgaataattggaattatattatttaaaaggataatatttatttatattctgatatgtgtttggcatcagctgttgtcatacatgaggttggaaataatgactggcttctagatagctcatcagttcatttttctgagcttcttgtgattattttagccctcagctggactactgctaaatccccatggcaataggatcccctctgattccttggtgaggtgatggtgatttaaaaaaagtagtttatacacagacacagtgatggcactagagatgttgaatagttgtgattacttagaaattgctctcgagatagaacatttgaaggaataattagaaaaagtgtgctgttctttttttaaaagcagcttgattgagatagagttcatatactacaaaattcaccctgattatttttaaataaagggaaaatattaataggtgtcctactacaaaccattccccctattttcaaggataaacaataacaaatatagattttaaataataagattatctcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacacgtatacatatgtaactaacctgcacaatgtgcacatgtaccctaaaacttaaagtataattaaaaattaataataataataagattatcttttcagtattattacagtggcctttagcattttaaaatctacaagcaagcaaggcttcagtggaccatgcagaatgttgtggttccctgtgttggagaaatacaagtttctatgggataaacaaatgcatgcacatgctggccaattgtcagagtgaaataccaaaaaattccgttgtggagtaagtgataatcagattataaagaattaaagtaagaaaataccttttgggttgtacgtagaaaagaacatgataaagattatcctcatttctttttttcttttcttttcttttttttgttttagacagggtctcgctctgttacccaggctggagtgcagtggcacgatcagggctcactgcagccttaacctcccaggctcaggtggttcttccacctcagtctcctggatagctgggactacaggcatgtgccaccacacccagctaattttttgtattttttgtagagatggggtttcaccatgttacccaggcttgtcctcatttcttgatgaatctttatttttcctttagagctgatttaaacttttttttgtgagaaatatagcatctatatagaaaaggtagttaagcccgagaaccagcatagtaagtagtataaagccagcacctttgtaactgctactcagatcaagaaatagaactgctggcctcttaggaatgtgccatatttccccctttgattatgactttccccacttcagtcctccaaccatgactttcaggctgatcatctccaagtacgcatatatacacacaatataaaaccatatatctatatgtatagtgttaccccttgagtgtgtatctgtaaccattaaagtttaatgtcacctattttataagtgtgaagaaatgaaatcaggtgttcttcttggctcagcatcaggtttgtgagatccattcataggagcatgcagtacatggcttgttttcattgtaatctagtataccattgtatgaacgtaaatataagtactggttcattttatggtttgtggacatgtggcttctacccaggtttttactgttgcctgttctgctttggacattagggtctataaaacctgatacacgtggcatgaatttttcaaagtatggttcctcttttggcagcattagcataaaacgtgttagaaatgttgattcttgggccccacctctgacctacattcagatatcaccttggactgtatattgtgtatgtttatgcttattccagtgactgcctttgctcaggatacttttggatcttccaggttggaatccattcatgtcggcacacacatgtgtacccatgcaaacataacactcccacattccagcaattgactcgttgctcatatttgaaaaaaattagctttatcagtttgagtcaaatcttttgttattttcaaagataaaataaatatccaaaagagaaagatttgccaacattgaagatattcaaaagaatatgcaaaagattgaagacctgctgaaggaggacctgaaacaggttgggcaaaacaccattcctagaatggaagctgcagggccctacagagaaagcagtactgactctggagttgagcagatgtgggttcaaacccacatgtacatgtgaccagcagtgtcatcaaagagagttctgcatttctctgagcttcagttttcctcctatgcaaagaggggatcacatctactaccaagatgcaaaacagttagtacaaaatgactgctcgcagggccacatttatactgtggatgcattttggtcatattttggtaacataatctgatgtggctgactgtgtcatggcttcatacctttcatgctttggacttttgtgctttctgcaggaacgattccaggtgaagaatcctccccatacatacattcaaaagctcaaaggctatctggatccagctgtaaccaggaaggtaagatggatttgtttccactctttgttattgcttccttattagcgagcagaatcctcctgcattggaagagaccttccttcctctgcattagagcctctgccagagcctccacaaaaaacaaccttgggagaccaacaacgtaagaagacaaaggaaaaaaaacaaccttctcacttgaagatgtgtataaaagttctttcctgacatgagagtcacgtacctctgatggttgttgagtcactgctatttccaattacgtagggcagtgagtgcattccagaggtattcaggcccctagaagagcaggctttgcaaagggaatacttgcctttcagttttttatgccttggtgcatttccagagaccttgaaaaatcactgggcctttgtcatcccagctgtgcactcacatcctgtgttgatgcttttagcagctcccccctactccccccaacccctgcccctggcctgagaaggtaagtagagaatagctgattccattctcaacagactctccccttttacaaacaagccctgctttgtgcagccacacaattggtttaaactgatgcctcgtggtaaagcatgtagcctggcacggccctgtgggcctgaatcagtcctgggatgtctcagggcagagctgtccttgctcaagatgggtgaaggggtgctttaccagatagcatttgtttttccattgacctacaactcctgcttttaaggctcctgcgaaaatctctcaggctgattctctctgttgtttcagtgtgtgattcttgagaaaagaatggtatactttacctagttagccattttcagggctcttgatgcttgcattaaaaaaaaaatctttttctttatcttctactctaactcttcctcccctcaccgcccaccccccgaccaaaaaaaaaaaaaaaaaaaagtccagcaaaggagaacagctattatttccttttggaagtttcctaggcctttctcttacggttaatatgtagacaaggggaaataaaatctagtagtgatgatgacagtgtagtgcagaacttcatcactggctgtatgtcatatgtgacttgaatgtgacacaaccttcaatccaggaacgtacctgtcaaagtatcatgatacttctcccctcgtaaatgtggcacacacatttctttctaaaagacctgttgtcaggtcttacacctgcaaatgagactattgttcagttcttgttaacttctctcatttctccctttccctaagaatgtggcagtcttaatttcatcatttaaagaggtctgtaaaggaggatacacccaggcctggcacagtggctcacgtctgtaatcccagcactttgggaagctaaggtgggtggatcacctgaggtcaggagttcaagaccaacatggtgaaaccctgtctctactaaaactacaaaaatgagccaggcatggtggcaggcacctgtaatcccagctactcgggaggctgaggtaggagaatcgcttgaacccaggaggcggaggttgcagtgagctgagattgtgccattgcactccagcctgggcaaaaagagcaaaaaactgtgtctcaaaaagaaaaataaataaataaatacagacacacccatatacacaaaatacatccccagacaggtgtttttctgcactatttctttgcaaagggacagcaagattctgttttagaatcgatttctaaaggttttctgaaatctccaaacttgtaaccttcaggctagatggctcagacctcagcattgagtcctaatgctcaccctgagttgagtgtggcagagatgctgatgtttatacagaagactgagacctttcctcatgcagaattcatcctacctccaaaaaattccttccacatttttccagttctgaatagaaaggaaaaaatatgcacactcctagggagtgctgcttaggcccccacttccataccccacatggaggaagatgcttagaaggaagaggtgggcttcctcctggcacagttccaattttcctttagatcagctgtttctgggtttaggcaaagagaacaaagtgaaacaaaacaacagataagcttcccagaaaatgttttgcttcctcacaaataataaactggagcaggacataagatgtctgtttgggccttcattcccgacatttctgccctggcccatgtgcgttcacctgaatggccatgtttggtctgtgcttcatctttcaagatcagtcattcagctcagaaaaaataaaatggatggtggattaaccacccctgctttagtaagattctgtcaggagctggcaggaggaaatgatctgttccacacaacataattgtaatgcttaaagcctggaaaaaaaggagatttgttgaaataagacatggcttgcagttaaaatgagcttaaaattctcagctgtattatggtgggggagaaaaagatttcaattcggggctttaaatttcagccagacagtctaggttgggcagttttcctttaactgtgtctggagtcctcgaatacttgattcgttaatcttttgtgcaaattgaatagaagatacttaatttgctttttttaaaaaaaaattttaagcattttctatttagattttcttctaaatagttttaaatgaaacctctcgggcagaaaaggaagagcctaaattagatatctctatgaacagaactctccaaaccagcctccttatttaataccaggaagtgattagtctgtgtttaaaggattctggtcctttgctggcgctgcagttgtgagatgaaacctattgtagggctcatcctgggctcagctgcctctgggggctcatcccaggcctcccttgatggggagggaagggagaatagtacagactgctcatggatcctctgtggctccccatgggcacataatttcttttcatagtgttttgcattctggatagattttagaagtgcaaagtgttagcactcattgtgtatatattagagaagtggactccaagacttctctgtggcccagaatctagccgaaaattgagccgttccttagataatgtaatacaggagtaaagtcagtttagtttgcctccgttatcaggcagttgcagaagggtagtgcctaggtagcatagtcagtgcccaaaaacagcgctgctgctgttattattacctcatcgtgttttgatttagttacctggtttcgatacatagctcttagtccttcagtggaccctcttttatactctgctatgtcctcagtgctacgctgggtgcccttgtgcctgatggcatacgtaagggatgaccttgccccgaggaagcagaaggcggcattaggggctgggtgttagttcctttgtgttgctataaagaaatacttaaggctaggtaatttatgaggaaaacaggtttattttggcctacagttctttaggctgtacaggaagtgtggtgctggcatttgcttctagtgagggcctcggggtttacaatcatggcggaaggctaagggggagcgggtgtgtcacatggtgagcaagagggaggaggtaccagcctctcttaaacagccagatctcacaggaactcttaggagtaagaagccacttattatcacgaggacagcaccaagcagttcaggcgctatctgcccccatgacccaaatacctcccactaggcccacctccaacattggaggtcctatttcaacgtgggatttggaagggacaaatatccaaagtatatcaggggcccagcagaagcaaaggctgcagggaatgagtcagaagtgcacataacacagagcttggaaggctgagttattttctgacaaccacctgtgcaggcagcccgagacttaggactctgacacgggagtggccacactgagcagccagcatatctggaaatggttgccttagctgtgtgaccagagaccctagaattttttgtctcctttctcttcccttctctatatacacagcagactgcctgctccattctactgactctcctctactctattcctaatttttagctccaaggaagagtttaaagagagagaatacctttagctgcccatcctgcattacttgcccccattctttttttttttttttttgagatggagtctcgctctgtcaccccggatggagtgcagtggcccgatttcggcttgctgcaaccgctgcctcccaggtgcaaacagttctcgtgcctcagcttcctgagtagctgggattacaggcttgtgctaccatgcctaatttttgtactttttagtagtgacagagtttctccatgttggccaagctggtcctgaactcctgacctcaggtgatccacccaccttggcctctcaaagtgctgggattacaggcgtgagccactgagcttggccattactcccttttcaagccaagtactgtgccgagcctcctcattgctgggaagtggtctagggagctctggggttgggtgtcctccaaactctcaagtatgccaccatttgttaggcctgtttcgacagaagaggggagtgcctctcttttttccatcacattggggacatttttatttcctacttcttactatacctggattctggaaacctgacatggtctttttagattgtcttgggaatggcatttatggaggaactgtgagaccatctgcttccttgggggctctgcttagaagcagctggtggggaagccaggggctttcagaagaagatgacagggtaacaggagcctgctgtgctgagccgtgcttcaggccttcatgggccaccaagtcccaggtgtgggcgtagctcttgccaccccacattctggaatccttacttccatcctccttccttttcttcttgtccttggagctgaaggactctgtgtctgctgcaattgtggcagcagaggagagaggtcctttatatcctgagccagaattctcaaagctctttcctgtaaacagtgtgacataaaggtggttcaggttcgtagcacagatagtctggaactccgcttaggaggcgctgacatcaagttttcttccttcaaagtggcctgagactgtcactttatatttctgtaggaaaatgtgttccaaaggactgatgtgcaatgtagcccattgatatcttggaaatgatttagggtcaagaggctagagaggtgtatattaacacatttactatcagaggtggattcagtgaagaaagaagccccgagggattcctggaagggtaggtgggattttaacaggcaagggaatgaggaagggcagttcatgtcaggagggtggtgtgctctggaggaaggaccctctaagtgaggaataaggggcagaggtagctctgcatgcttatttttgcaacgtgttaggtcacgcagaaaaaaaattaacatagcaggcctgagactgctatgcttagcaaagggcctgcctgcaaggttggcccttggctggcatctaggaacttgtgtttgacgggggaaagttcctaccatttcctgataagactgtttcgctgtgcctaaacagtttatgaaaacaatacggcttatgctgaatgcctcttttccctctgggagtctgaatttgtgtaatgtactaggcagagagttgcctattaaaccagctcccaataagaacctggccactgagtctctaatgagctttatgcatgttgtcatttgtgtctcctcggggagaggactcctggaagattgcacctggtttcctgcacgttttatcctatgcaccttttctctttgctgatcttgctttgtattcttttactgtaatacatcatagccacgggtatgactgtatgctgagtcctttgagtgctcctaatgaatcattgaaactggaggtagtactggggtccctgacccataggaatattggtgaatactgttgtgtgtgtggggtagggaaataaaatctacttactgaaaggcacattacataaaacaaggactttttgtagtcctttctcagtagttaattttcatggtgaggaaaatttgtgtgctctgcaacaaaaaaagtgagggaagcccattttagaagtgaagatatttttcatattgtgttaaatttattataactaagcttcagttatagcagttgctaaaatattttgtgagaatatgtgttcttgaattatagaaattcagacggcgtgttcaagaatctacacaagtgctaagagaactggaaatttctttgagaactaaccacattgggtaagtatacccctttaacatcttagctctaaagcttttggacactttacaaagtaactgaatcatacccaaagaattgagcttccttatgggccattataaattaaaagactgaggttttagtagatgaaaccttgttagtactcaaattacttactgcccaagaatcagcagaagcaagacagatagtccttgatgtggaatttataacaattctatatttctttgagcgggtgcagtaaatatggacacttggtttcatgtgtgcataacaattctctggcaaatcagaaacccccaatagtgcatgtagactgagatcttggaaaatctctaagcttttactgtagttctccaagttggttggttgaagctgctttatttccctttcgttaattctctagagtttctggccagaaggggacggaagctggaataatgtcacttgactcacctcattgcactcagacacattctcagtctctttttcatacatctcaaaacctcaggaccatgaagtgtaaatccactgtgggaaaataaagttcagggaatctatgcactaagcattctgagtttctttcagacaatgacatggtgctttgcctcaggcaagaacagcaatattatattctcccttacccctgggtggcctaattgtactatgtcttaaaacaagatggcttctctctaaggtagaatgatatcaggtatcctattttgtagccctccttctgcccaaagcacctgcgtaacattgggcaagctatttaacccctttggttttgattctttgagctttacaatgagaggactatcgacttttagatcttttagaattttcccatgacattctttgcaagtctattggaaattaattttgatgtatatatattgcactttagttttacagagtatgctgtaacatacagtaagttctgtctcgttgatagttcttcttgaaaaccatgagtttaagtgaaataatgttgttataaaaccttttccccccctcatcaatgtcataatgaaataatgttatttgaggttaagtaaggacttgatgtggatttattatgtagataaaagtttacttcagactgctgtaagccattcaaatggttaattagcatagttatttcaaaataaacttttagaaactgtagaaatgctattgtgattgataggtgatggaacttgggtaagaatgtgcatttcttaaatgataaccagcaggtttttcaccttgagaatgaaatattcagaaaatgaattaattctagactttgtccctggaaatgggctatagaacaaagaatcatagagtcatgattttagaactggaagagaaattaagaattgcctgatgcctacttttacagattaaaagaattaaagaccagagaaggtgagtgaattgcacaaagtctacagctgtagagccaggtgctttggctcaagttgctctgttgtttttcctgtatgacttatgctggcagccgtttccctgaaagtaaataagattatcagggatctgggatcaaagcaatgaggcttgtctgctggggatgaacatggtagtagtttaatacttttgggcatttagactcagcacatttaaatactttctaatatttatgaatcaggagctagattcgattttgtttggtccaaacctttgcctttggcccttttaactgaaaatggtggaatgaactgcagccaagatttctacaaattgtcaaaaagcatttcttaggctgtgcgtggtggttcacgtctgtaatcctagcactttgagaggctgaggtgggtggatcacctgaggtcaggagttcgacaccagcctggccaacatggtgaaaccccatctctactaaaaatacaaaaaattagccaggcatggtggtgcgtgcttgtagtcccagctgcttgggaggctgaggcaggagaatcacttgaacctgggaggtggaagttgcaagtgagccgagatcattccactgcactccagcctgggtgacagaacaagactccatctcaccgaaaaaaaaaaaaaaaagcatttctttaagcattgccgaagtaatgtgaaattgaccatcaaatacaaaaggaagatgatcatttccaacacaaacttggctgaatagaagaaccttggttgggttgaagccagtgcagtctgcaagcaattggagtggtttgttgttgaggatactataggcatattgaaagattcttagatttctttcatccttaccaggtgaagttttcccttgcccaccatctatgtgaggaactctgaaagctttggctttagcagcagaaaaattcatggagatgcattgtctgattatatgcaaccaatcactagcataaacttacgtgaagtaaaaccacacaaccagattgtgaccatcttgcctgttctgaaaacccaaacctgaactcactctttgttatgtaaactaactggcttgctctcacttgatagggatatcttctgaaaaattactcaataatgatgaaaataatcagttactaaaatgaagaattcttggaatgcaaggtgctatttaaggaagccatatattttattgtactgtttaaaatactgtaatagatagataattcagtgagtgtggtgacccacgcctgtattcccagtactttgggaggccgaggcaggacgattacttgagcccaagagtttgagaccagcttgggtaacatagtgagaccttgtgtctacaaaaaaataaaatattagccagtcacaatgtcacgtacctgtaatgcctgggacactgaggcagaaggatcaattgagcccatgagttcgaggctgcagtgagcagccattgcactctctgagtaacagagtgagaccctgtctctaaaaataaaaaatcggtgcccatttgctcaaatttttgctatgcccctttctagttatttgaccttagataagttatgtaagttttctgcacttactatgtgacccaagttaaattctcattgataaaattagtataatacttacatcacaggaatattataaggattagatgacataacttgtaaattcctaataaagggtctgaaacataatagttactcaatatatgatagttgtttgttatgcttgttgcaaataattacctgcagtattcaacagtattatatatctctaaggatatacatctcttatatatatctctaaggaattccctaaggcagagagtattatcatctttatctaaaatgatcctgacacccaggagattatgatacccagaaattaaaaaggagggattacatttacaatctacttgtcctaaaaaaattgttctgggcacatgcttgcttttcaacgttaaagacttgagctttcccaagataacattctgagctgcagctttgtcaagcaaaggacttcttctgagttttgatataagcctaaaactctataaatggaacaatcttctgagaaagaaaattaattttctttgagtcaaattgaaataagaattggactagaaataatcccattcacttactcttaggaactataataatagagaagaattggattatgacttatctaagcttttgaaattacttgaaatacccttgaaatgatccacatagtgttagaatacactagccatgcagtgtgagtaggcagatgccatggtgcttaagatgtcagagtgataggatttaaatggtggtgagggtgaactggacagatttaccagctttattctatggaactgatgtgtacactgtctctccttgcagggaatttattgtagtaaagctacctataatgatagaaaattacttttcatcctcagtgcaaggtcacagaagttctgaaagatgctcatttcactttctcattgtggtgtagagagaacaggcatgagatggcagaaggaatgtggcaagttggcaaggaggggaaggaggtttgtagaaaagggaagatgctgaggaactgcttagttgatgtcttctctcctgcccaccagacttctttatgaatcagtgctggctgagccaggccaaaagaagaaagacaggagagtgacaaaggctgcttttaacatgcatacaacacgtatgggagtgtatgtgtgtatcaagctgccttatgattaacttattcctagatggtacttttttagaaaccatcaaggttataatcattttgtcatttattaagcacggtgttaggtactttacgtttgttattctgtgtatttcctacaaaaatcttattgaccattagccctgaatccctgttttatggatgagaatactgagggtcatttattaagtaccttgctcaattccacacaagttagaagcaccgagatttgagcctagatacggtcacttctaaaatttattactaaaccagcaattctcacattttttttttttttttggttttagagtgcctttatacttttaacttatttttgaaccccaataagcttttgtttagatgtgtcaaatctattaatgtttataatattagaaattaaaactgataaattttaaatgtctttaataaaatgtaatatttaataacatttaatttaaatacatataaaataaatgttatgtattaacataaatattaatacattataaattaaatgacatgttttatgaaaaatattcttcaaatccaaaaaaaaattggtgacaaaggctgcattggtttaatttttgcaaatctccttagcatctggttaatagttggcagctagattctcctgagtcaacattcaatttgtcgtgatctgttttgattgatgtatatgtagaaaattgggtcttatacacacttagagatgagttttttaaatggtcttttcagataattgggatattctttttttagtagtacccccaaaattgaacggctagtaactaattcttacagatagctataatgtagagtctgaaatcatatcagtgaactttttgtgctctgttatattaaaatccattggccaggtgctgtggcctgcagtcccagcaactttggaaggccaaggtgggcaggatggcttgagcctgggagtttgagaccagcctgggtaacatggtgaacccctgtctctataaaaaatacaaaaattaaccaggtgtggtggcatgatcctggagtcccagctactcaggaggctgaggtaggaggatcacttgagcccaggaggttgaggctacagtaagccatgattgtgccactgcacttcagcctcagcaacaaagtaagaccctgtctcaaaaaatcctttgtgctgtcttacactttgattgggtctttttatccatacatgaacttgtgacatgatttgttaacatcatgttggtcatttggaagatcagaataactcagtaaaatcatgtttctccactgttgaagcatatccctttacaatgtttttaaaaatcacatttgttaataaccaccagtctgattagaatatatgttaagtattgagaagctgtcaaactgacggtggtgaatacaggttttccagaattctagtttttgtttgaaagctcaaagttggtcatcagcaacaaatactgtgttgtccttgaaaggatgggctcacttcatatttgagtaaatgtctgccacataccccaaactgaatcaccatagtttgtcagttatttttacaagtaaattgacattccatgaaaaaatggctagttcagctcgcaactcaaacaatttcacaggtgcttttccttgagacaactgtgctacttgagcaggtagcagaagtactttatgtgagcttcctgttttgtcacactgaaaatgaaaaagatgtgtactaaatgagtaagctttaataaaatcaatattttttattgcttatctaagggcgttcttaagtgaagctggccttttccccctcctgagtgcacggagtgacaaatacaataaataagtgtcttctttggttgcagcagttttatacagtatttctttggcattgtaagtgtcagtgtcaacagattgaaaacaactaatgtcctaatatttttgtgaaaacagttttaccttcacaggcgccctgagagggtttcagggacccctagtggtatatgggctatactttgagaatcagtttgcaacactgcctaacagagtagatctgatgaccagtgttgaatccacacagtgcttctttctcttgcttttcatgatttttcatcaacttcagttcccaacatatgtctgtaggacctctctctagaggaggctggcaaaaggaattaactgctttttcctttctgttgtgcaactttgggctacttggcttgatcttagaaattgaaagccaggaacatctcttaagacctatatgaggagaaataaggttctaagatttggggagacagaacaaagatttgatattaagctgtgaccagcctacaataaaacagtgactgttggcattggcacttacatctcttccttgcacccaatttcttccagagctatttgtcattgtccctgtcttttccagctcctaagcatctgatttagaatttgcctaaattcagatgtacagcatatggtaattacattgaatccgtgaggcactcaggaagttatgcgttctgtcagagtcagaaataattcaactttccaaaacctataatcacccaatttgaaactgtttgcctattggcaacatattaaaaagtgtgtgtagcatgcacagaggtgaaatggaactaatttgctatgggaaccctgaatatatgatatagtccttgcatgatcatttacataaatctgcaaaatgaggcatccatattctttgaatgcctttagattccagttactgctttgaaagttgcccgtttttatctttacctgttttctttccttactcttatatttctgtagaagttcactttcaactccaattgaaaatggccagttctctccaatacagaaagttccaagtcaagaaggggtagggactgagataatagttagaaaaatgggggctcttttttcatgtcatccatacccttattgctgaaatgactttgctaagctaacctgataccatttgataaagtggggaaggtagccagccctgaaagactgatctcattctttcctaaagcagctgggggtgtcaggactagatcaaatcccagggaggatcttgtagctttgaaaaagatgttaactgcatgaaattaaatcaggggtaaaacatgtcacactttagctgaccttttaggaggtaggcagcaggctgttaccttttactcagaaaattgtctttgaggccctttcactcaaagtcaggaagtggtgatgggggcatggataaggactctgaagtgaagtaagaggagccaatgagtattctttatccctgcattaaaacgtatgcatattagcatgttaagcgaattgtaactctggctgtacttggctatttcctaccttaaaaaaatttagtttttcttctgtaggtcacttgcctcttgtccaattggtggctgaactttccaagtgagatggaggtgcctgccagtagttgacacaagggcaggcactgagtgcattctgaatggtctgcactctacagaggctgcatctggaaaatcaaccagaagaaacgacaatggctgtttctcttagctcctaaattagtgtgttcttatgggccactgagaatatgtacaactgagactgccctgaaaaatctgcccccctccccccgccgtgattatttttcatattaaaaagacacccaccaccgagggccagtttaaattgtacaatcacagcccataggccaccaatggaaaagcctaagcaaggctaaggggcttgaatttaaagattttctaatcatcagattttgatattgagttccagactttaagtctccagccagttacaaaaaagaaaaaattctttttactatttctaagcttctaattactagtatttaaacgtgatcagtgtctcctgagacctagcaccacagaaagtacttaaaataaataaaaaataagtatctagtaggtgctgtgagattgtgtatgtggctgttttgaaatgaaacttcagcctccaccagtagccagccctgttagttttgtctaggtctcataacaaagccactttgtgaggcctaccaggtggtattttctttgccaccgttgccactccaggtctctcttaaattaaatgttatatgtttacaggcagctatgccaagtgcataggttttgcagttgcctctctgaggcgcttgaggggaaaacacaaggcaatctttccactttcccactttgccgcctcctggaactacctgcagacctgggctgggtttgcatcatggagatgacaggactagaagaaagaatgaccttgaggatgaaacaaagaaccccttccccctgccaaaaattaaaacaaacaaacaaaaaaccaaatatcctgattccatgggattgttttctgccttttaagacaaagacctcaaggggttgctcatgcttaagggatacttggtagaattgtcctactgttattttaataactaacaaaactggcttccatagtcactatcatgtccatagctggtcagactttttagcttggtgtttctggaggaaagcaaccattgtggaatgcaggtggcagatgtacctcaagtggcatttcagcgatagtagtagatcttttaacttattatttgttggagtttgaaacttagtgaaggtttaatcaggtaccatatgttgtttgaagatgaatgcactggaggaaatctgtaaaagggggtggtgacattttacatccatctccctaaagattctgtttgacctcccatcaggattattatgaagaacaaataagaatgtataagcattctccatgcactgtggagcaccattcaaatgcaaggaggtattatttaaaaatgaattttttaaaaaacctgatatttgtcatgtgccggccttgatgatagtatgcggtgcctgcagctttttaaaaaggttttaacattcatggaaaaagttaagcaaatcattatccctattgaatttctagaagcccataaacagtggtctctcattggctagtttagtggtttctgtagcttagtgtgccaaggacttgaacttggatttggaatcccgcctggatttttgtggttatgttgtcatgtcccccatctgcctcattgtccatagtcttgcttccttccacaagcaggctgtagatcaattgtggtggaaaaagtacattaagcaagtgccttctttaaagaaagtttcttacagattatcttaaatcctctaagcagtaaaatgcaaagatggcccacgtgtactttttggcccttatttttgcacattaaaaagttgtggttttcttagttaccatatctgaaaagctcctgcctcatgtgaagtagtctaggccttcctccctatgtcctttcaggcaatgaaagtttctggtggaaaaaacaaaactttgcattgtgtccgttccatggcaggtcatgtgatcaatttctccaatgatttttttttttttttccccaacagatgggtcagagaatttctgaatgaagaaaacaaaggtcttgatgttctagtggaatatctctcatttgcacagtacgcggtaacgtaagtaaaacttggcttgcttgcatttgaattttatgtggtcacagcagatgctactcagtggtaaaattatacaccacagagagggcagaaactcagaagcagatgtgctagggcttagggaggtttgtttctgtttgggtaactaaaaacaaatcacataatggtattagaaatgcctttaaggcagaagtaaaacaggtgaataaaaatcactcttaaaggagcccttattttcaaaagtaacgctttctttagggcttaagttacatatatggaagaatagtctaacagttggtgaaagaggtatgtgataaatcactaggcgatgcaaaagagtgactccctttttcttttaaaaatgatgtctgcatgtatatttgcatatgctagtaagtgcatagaaaatgattgcagaaacagataccaaacgtagtggcactggagggagaggtaacaggaggctgttcctttttccttgatatgcatttgtattgttttgattttctgcccataagctgaaggggagtaaaaactggagtgcagtggcatgatctcggctcactgcaacctctgatcaagtgattctcctgcctcagcctcctgagaagctgggattacaggcacccaccaccatgcccggctaatttttgtattttcagtagagacggggtttcaccatgttgggcaagctgctctcgaactcctgacttcagatgatccacccgcctcggcctccccaaagtgttgggatttcaggtgtgagccaccgcacccaacctagaagcactcatttctatgtgtgtttcctttttctgctgtgtgagagtgaggatgagctgagaggaacacacgctgaatggcgtgggagctgtagagtagcctagcgagggcatcaatgccacgagtgatttcaggatgccctcctcgtcttaccttctctcatctcagtgattgctttctctttttagcagttaaaattttattagattaccccattctaactcttttatgttcagtattacctcctgcagccaaaggcatgacagaattgtgaccagttgcctccatggactttgtgcatctatctctgctatctgattagtcttttataggtgaaagtcatcaccaattttcagatgaaggttctaaccaaatattttattttggcagttatacttttataaaaagttacactttgatttccaatatgtattattgttttttcttctgcagtatcctctaagattttcctgaggatattaagtgtagctaccttctgattgttctactgtctgatcaggtgttgctatggatagaaacaattaatacaatttcttttttttttttttcttttgagaaagcacagttactttgtgaggggggaaatgcatggagcacaaaagcctgtctgtttaaaaactttgttcctaaaactatacaagagtgagcaagttaacttgtcatttattctaacatggttaacatgagtaataacctcaaaaaatgtcagagaaacaacagtcttactttaaagagcaccacactgggaggagattccaaaatcaaagcaaatccataactttgctagtaatgtatcacatatgcttggaaaagtacacttgccaacacactaggagaaaatgctcagtgaaaattgatgggtaggaataaattagtataagcctaacatattgacttgttaaagcaaaatgaagacagctgtaagatcttttcccccttccatcataccaatgttagtgacttatatattagcaagccttataaaataaaatacaaataatatatcactatttaatttttgctgctcattgttccattattcttttgccagacccattatttgtcattctgtattcttaaagctaacactgagcccatagaaattccattatatttcctttccagttttctttgtttacaaagactttccatactaaggtgcagatgtcttgtaggaacagcaagttatacatgttcgtttatacatgtgaatgtgaatttttcagtcttcaatggcatttctcttttgttttagttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcggtgagttcgtttaatcaggaggcaactttggcaggatgcactgggacagcaggctcctacttcttttgatgattctgggcactgtatctcataaattgccatacagcactttcatttgcaatgactctaaatgaatgtttctttaggagttcatgggatcttcccttgggcaatgtttgataactttaaatagcttctggaaacaccataccttgattcagcatagaaggtgggaaaattctgctgccaagtgatagaacaggatagtctcataggcagataaggttttgaaaccaggggaatgttgacatcctgatggaggtactgtttccagggtagaggcagcacttagagatctgggatctctgccctttgttaccctttgtccttccgctctctttcatttctccagtggtagctcaggttgtgtgctgtgggtgttttcttagccataggtacagaatgctgtagtgataatttttattagtgagatgccattaaccagtgttcctttgattagatatgcttcacttgtcaacctttttttttttttttgagatggaatctcgctcttgttatccaggctatagtgcagtggcacaatcttggctcactgcaccctccacctcccaggctcaagcgattctcctgcctcagcctcccaactggctgggattacaggcacctgccaccatgcccagctaatttttttttgtaattctagtagaggcagggtttcacaatgttggccaggctggtctcgaactcctgacctcaggtgatctgcccaccttggcctcccaaagtgttgggattacaggcatcagccaccacacccggccagttgtcaaccttatattttctcctaagtattccctttctcatctcttctggctaaaatagtaccatgctaagggaggattggtgctgaccacctgtactagtaatgggtttaatattgctgaggttgttcattcactcatacctacaatcattcattcactgaaaaatatttttgtgcttcttatttgtcaggcgtaacacttaatactaattgtatgttggtggataaatcaaactcctgcctatgaggacagagatatcatctagaacaagtttgtaacggtttctgtggttcatgattttaacataaaattttattaataagaccttcattccaaaatgttgcttattctttcctttcatttttttctacactacccccttacttactctttctagcttaaagtgtttctatcttatttcaggcatgatctggcaagaggacattatttctctaagtgtttacgatcactccgggtattcagtcattgttgtagaatccatatgtcagattgcagccagtgaatatgtggctttcagacctttggatttggttgtctaattacctcttgtccctttgacttggtttttggtcatggaaagttaaacatttctctgtaatgaagttaagttctgctgaaggatttgatatttgagtatgatacctccagtaaatcatttagattttccttgtttagaactggaaaaaaatgttaatgggtttggaatgaattgattcaatattaagagcagtgtttcaattcaccttattatatttgcagtaggccaaaggttgtgcaacctgctaatctgcatcagcttcacatgtgggcaggaatatatgggctgatttggcagatatataaagaaaggctaattgtctgaagaatttcctgatcaccttggaaattcaggatgaatttcctgatcaccttggtactggaatggaaattctcaccactagtttaactgtaattatttgtaagggatttaatttacaaagtacattttaatttggttttctatcattggacacttagaaagtatcatgtattgccaagctaccaccttagtaaggatttgtttttctggttaataattcagtatgcttactttttaaagtattttttccagtagagcagaagaatcgggaaaatctgggaaacttcccaggttcagggagggatgtaaccctggatgctggaggtcgagggacatccaaggccagcctgttttgcttcacagttttgcttcaaagtggatcttgctagaattaatttcaaattggaaagtcagaccaaaagcatgcagatagggaaattgtatctggaaaaacataggcattatatatatgatgtttctggttggcaggtgtgcttgaagatgaccagctaagaaaccaataccacattcttctgttttgtgttttaatattttcaagctcaagaacagaacatttaaatttcctttgattctgctttatggtttctagtagcccaagaaagctgataaggcagtaactttcatgccacttaaggacctgaagcttagatttttgttttgttttttaaacaatgtatatcaatagttttccagctcttgtggttcatggatttatgtctggattctaattctgtatttggtcattggatatagcatctgtgacataaaaacagcaatcagaagtacaggcatatggtacatgttgcttttcatatacccaaacattgtttacatttttttcttttcctccttctctcccctttctttctcttctccacacgctgccttcacttttggctttctttttaccatcctcccttttcttttagccatctcatttctgattgtcttctcctcttctactttgtcctttctcatcctgctgtctccttcttctctggtttcattaatctctcatgccaccaccagattggtttctctgcctgagtattttcagttccattgccactagagctgcttctcccctcttgcctctggagcagcttcagtttacatactgatgatgaggcttcaaaccggaaaatctcataagtctcgggtgaaaacgacatccaagcgagttcacagtgcatgctggcagggcaatccgactgctctccatgttataatatgataaccttgtggctttgtgctgacatgccatactagaataaagcctgctgccttttaaactttgatacactctgttatcatattatgattcctcatttttagaatttgaacctttacagtatcttgcattttaatagcacaggttgtttttttttttgaaaaagaaaaagtatataaattcatgctctatgaaaatgatttattctggtagctttgtttaattagtatatgtcttctgtatccaaatgcagattttagtttcttctttttaatctcccgataataagacagacatattaatcttatctgataccacttggcaaaaggattggttaatcttggaagaaaaaaaatgagatttcaggaaatttaaaacacattgtaaatgggcatgattaaagaaaaaaatgaaaaacactgtgttcagctgggcacagtggctcatgcctataatcccagcactttgggagacaaaggtgggaggatcacttgaagtcaggagttcgagaccagcctggccaacatggtgaaactctgtctctactaaaaaacaacaccaacaacaaaaactagctgggtgtggtggtgcacacctgtaatcacagctacttgagaggctgaggcatgagaattgcttgaacctgggaggcagaggttgcagtgagctgagatcatgccactgcactccagcctgggtgacagagcaagactcaatctcaagaaaaaaaaagacaaacactgcgttctaaaatacaaggttggttttttttttttttttttttttaaccaaattctaatgttgacacacattttcctccttgtagtcatactttactttttaattattcaaaattgattgttaaacattttatgtcataacataccccttgagtcatatcagctatgggattctgtattaccatgtatttgtcagcttggctagagggaaactgttgctattgatgcagtagagacctggtttgtattgtcttctaaaattagaatgtggtgtgccttcggttaagataggtttctgtcagtgcggctacagagctagctaaatttaacaatgccatataggcacatatgtgcacatcagatctatgaagacaaaggctgtgttatttcagatgcaagagaaaatactttctgatttttaagaaggtccaagttaatgctattaactcgagtaagaaatgacatagcaagtaaatgagtttttaaagaaagaggtggagtactaacttagggtttggaggaagggacaaatttaaactggactttaggcaatgtccagagttggtcctcagggtaaggaaaggttgctccaggtggaggggaagtgaaagaacatgagttgagcacagccctatataaagatcaggtgtgctagggaatgagagaagaacctgtcctttcaggaacaggtgctttgtgatggaggtggagagctgtccagtggagagagagtcataagacagaaaccaagattcacccttgctattgatctttgtaaccaaggatgatcttttcaaaataattatataatcccgctcattttttccttaaaatttttttgtcttcttttactttcctgaatatgcccatagtttacatattcccattgcaacggtttattttcaaataatatcttttctttaaaaacaacaccaaggtccacattgcctttaatacattaactaccattaatatttcttctacactcctccagagtaagagtttgtttttcttatgatgatgatgatgatgacgatgattttttgagatggggtcttgttctgttgcccaggctggagtgcagtggcacgatcatagctcactacagcctcaacctcctgggctcaagaaatcgtcccccttcagcatcccaagtagttgggcctacaggtgtgtgccaccacgcctgcctaatttttaattttttctgtagagagacggtctcactatgttgcccaggctgctctcgaactcctgggctcaaacagtcctcctgctcagcttctcaaagtgctgggattacaagcatgagccaccatgcctagccaagataattactttaatggaatggcatttcatgaatagtccttatctgaatatttaccacttgtatccttagtggatttacgtgaagagatgaagaattcaaatgtaggtccttgtttatatatttttaacactgcagtcccattcctggcgatggttttcatagaagtaattattaaaagtatttttcagtggtacaaagatacagatagcgttgatgtaatttttattggtgagaaagccttttcttaaatgtctgttgtgtggcagccactgtactaagggcctcgggggatttgctgttcacagtttactgcctctgtgagattgctactgttataccactgtgaggaaactggggcctgaagtagtagtgaaacaacttgccttgggtcgaacagtaagtgaaggaggcaggatctgaattgaagtggcttatcaaggattggaaaaaacactgaagaggcctcagcaaattcttgtagctgtggtccagtgccttcatgggcaagactgattatggacttagtttgtaaagggtgccttgccaagggttaaggatacagaaagatatattaaataatatatttgtatatgatttgtggctgacaagggacttaagtatatatatgtttgtgtgtacacatgtttgtgtacatgagcacatatatgaaatgtcatgtgagtgtaacaaactctaacaatacggaaatgtagaggtgagagtaaacagcagaacctagggagtgattcacgagacttggtgtggatgtgaaacaacaatgagtaagacccagaggggtggctgggaaaagggagaagtcaggagagtgatctgagcggaggttcagtggtaagaccgcatgcttcctttaggagacagtgaagagatgagcctggctgcaagtcgtttagagacagtttatgtactattctgaaggttagtctgtgaaattgtcactgcagctcattggcagtgattttgttggtttttgaaaagaggggataatatgggaagaacatagaaatatttccatttaaaggtcacaggagtgagatggtttccttggacacatttcacatggggctatgtcctgattaattagcccccccaatagcaaatgcctttgacaaatggaatataatgaaaaataagaaaaatcaggctaatagtgactctccattcatatgatgggttgccagcctcccctttcatttgctccattcaaaaagtatgcactgaaacctttgattagaggctctgatctagctcttatctggtcctctaatgggacgtatagacagcgtttcaatgcctgatttaaaagttcattaggaattttgtttacttttttctttctttccctctttctcttcttgatccctctacctctcctttgaattatctggattcagctgtttcagctctatttcttttggctgtagagacagtcagaaaactgcctggcccctttttttagcatcatatattttatgagtttaattgatagaaaaaatatgcccaagtgatgtcatgtctgaaggataagaaagaggaaacctaaaaccccaaatcttggttaaagttctattagcccagaccttggaaccataaaagactggtacaattctgccaaattctgtaacatacctcattggtgttgcatttcagtgggttgaacccttatgtcagcttccgagggagttctatactattctttatttataggtagatattagtttgagatctgaatagtgtgacagactgcattttccttacaaaaatgctttttgtcagcgagaaaatatagcttttcttttacttgttcccattagggcttagatattatgaatctcacaaatgttggcatggaagctccatagaaggcttgtggaaaacctttttgctagactccaggaaagcctggttagttcaattcaggaaacattctttcaaggttctgcggtattatgtagtctgggtattgaagctcaaggagaaagacagacatatacacaactcacatactagaataagtctaaatgtctagaaataagtgtatattgttgagacaatagatgggtgatcacagttacttcaggacattactgggtgagcaacggcttccattttggtgggtttttttttttttttgagacggagtctcactgtgtcacccaggctgggatgtagtggcgtgatctcggctcactgcaacctccacctcccaggttcaagcaattcttttgcctcaccctcccaagtagctaggattacaagcactcaccaccacacccagctaatttttgtatttttagtagagcagggttttaccatattggccagggtggtcttgaactcttggcctcccaaagtgctgggattacaggcgtgaaccaccgcatctggcccattttagtgttttctaagtgcttggtgctttacatgtattagcctgttgtcacactgctataaggacatacccgagactgagtaatttataaaggaaagaggtttaattgactcacatctcagcatggctctggaggcctcaggaaacttacaatcctagtggaaggggaaacaaacatgtccttcatcacatggtgacaacaagaagtgctgagcaaagggagaaatgcctcttatgaaaccatcagatctcttgagaactcagtatcatgagaacagcatggaggtaaccacccccagattcaattatctcttactgggtccctcccacgatacatggggattatgggaactacagttcaaagtgtgatttgggtacagacacagccaaaccatatcattacagatataaatctctgagtaaatccggtgtttgatttcttctagctttttagcttatgagtagaggtctttctcctctactccaagaattttcatagacacaccacttagtacttacgtttaccaccattgttattatttttaagaatgtactactttatatttttaaacatgaaggactagctcaaaattttgtagcttccccccccgccccaatcttttttttttttttgactcctttgtgatgggtagtggtttaaagacagcaaaacatgactttaaccagaacactaactagctttatacataattcagcctatgaacatgtatctggcaagagaaattcctgatctgtggttcggcagatccatgagagctgcttctccggattttctttgctggccttgcttgctttttgtgctcctgtcaaaaactcaggtttcgcttgctggttggagctcactaacaaaaatagcttctttccctatagcgcctgctgctggtgctgtgcaggttgaggtgttccatttgtgctccttgatagattcattgttgagcattaagtaggtggctgggtgcagttgtcacctgagtactaaataggaaatgttctgtgtagatttcttaaaagatatttgcttagccgggcgtggtggtgccacccgtggtcttagctccttggggggctgaggcaggaggatcacttgaacatgggaggtcaaggctgcaatgtgcggagatcatgccactgcacttcagcctaggtgacaaggtgagaccctgtctcaaaaaaaaaaaaaaaaaggaagttaaaaaaaaaaaaaagatacttgtggctgggcatggtggctcacatctgtaatctcagcatttgggaggtcaaggtgggcagatcacttgaggccaggagttcgagaccagcctggccaacatggtgaaaccccatctctactaaaaatacaaaaaaattagcttggcatggtggcacatgcctgtaatctcagctacttgggaggctgaggcaggagaattgcttgaacccacgagacagaggttgcagtgagccaagagtgcatcattgcactccagcctgggcaacagagtgagactctgtctcaaaaaaaaaagaaaagaaaagatatttgcaaaaatcgcttagttttttaaagtctatcactcatactagcattgagttataactttttcttttattaatattttatgtacatataactattggtatctgctgggatatgcataacactaataaaagggtttggagtaatttgtttggttatgatcttaagtcagttttgtaatctgtaatctgcttctttctgcattcacagagctttgtgaattctaactggcagctcttccaagatagaatctcatctttgaatgctagggtaacatttagagttttagttcagtggaaaattagcaggtagttctcttaagtttatgtagaagaggggctgggaaatttggtgctgttagtttccgtacaaaatcagccctagatatcccttccctattgtatttttctacaaatggcaggagctccaaaaattagactcagctattttctgtctctgggaagcccttcttttgtgtacaagcatccagggccccaaaggctcttcttgccagcctgggagaagaaaggctatcagcatggcatttagataatcagcctcagtggtccaggaattgggtcacaacttctccatatttcatttcctgtttttctctttggaatctgagggagtcctttccaatcctcacatctcagggaaccttccccaagtcaccagagagacctgattgttccatcaccttcttagacctgttcccatcaacttgaaagttacacttcagaatgaataggttggaaaagttacacttcagaatgaataggtctctaaatgtctgttatggaatgctggtgaaatggttgaattaagccctctgaaaatgttctcatccataaaagtgataagaaaactggcaaaaattactggaataaactttttcagaactctagaaattaaagtcttgcagtaacccagggagcatctattcaggaaaagggactgattctcagagcaggaagttttgtggcattttaacttgttctcattcccatccctccctctccagttccacagtagccttgaaaaccagtagctgcaatcacagtgaaaaccagcagcctggcagcctctggcaggggcaggatggcgttggagtgtcttcaaagcacctctgcctcctccttttcctccttctcctctcctggctctcccttctctgagatttgagaactgctggtggagaggagggcccaggggagtgcattgctgctgaaactgatttcaaatttcagtttagggaacatgcaccattagctgttgacagagtctgggatcatgcaagatgtattacatgggacaggactaaataaagctcatgtgtgccaattatccatgggagtccatggagaaactgatgctgcctctcactggagcttttaaagtataccacagtgaattggagggacactctccaatttggttctgctcaaattatgtgaagtttcataatagcttcaggaagaaaatattatagtaaccgtttcactttatgtaattctgtaacagaacacatgccaagggtgttagtttgccacagaggtactcatgcctcctactgagtcactggcttaatccctgcaaagctcaggcctttgtagaaagtttattcaaacaggtaaactaggatgatcagtgtttggaaaacgaagaaagtttagcctagagggctgtggcaaaggacctgatgcaggctgccttatcctctctttcaaagatagtatattgaattgatttatttgtgttaagatgattatacaacagcatcatgtatatacattattttatagttataactagtttcatttgagcggtttgaatgttaattggtgacggattactgctgtgatttttttttcaatcttaagtgaatcggtgtgacatttatttagtagagttttggggcactaatcaattagcctcatctttttttctgtggaaactgtttgccactgaattcagccttattgttatctaggtggacatttgcaacaccaggtagtaagattttcaaagctgagtttttctaatgatatttggttcttcagtcctgtgtattgtggagggatttggtctcatcacagaaatctgcaaatgtgcttcatcgggtagatcaggaccagctctccatctaaaaaggccttctaggagacatcctacagggtgactgaggaagagtgtgatgatccccttatctagttagctctctatcttaaggtctaaacctagaccatctcagtaatgtttagcataaacaataggtacttagtaaagccaactttggggcttaaaaaagagatttggtttgatttcctgtggctggtgagcaccagaggccatttcctctagattgcttaccttgtctaggtgttcttgttgtggtaaagtggctaatatcttgtaaatcctcattctgttgctgttttagggtcagtaaagccatctcctcagggaagtggttattagatagtgtgagcttctgcagggcgcagtggctcatgcttttaatcccagcactttgggaggccaggaattcgatacccacctgggcaacagagcaagaccctgtctctacaaaaaaaaattttttttaattaactgggcattgtctcttgagcccaggaatctgaggctgcagggagccgtgatcatggtactgcacttcagcctgggtgacaaagtgagacccttgtctccaaaaaatacatggtatcaacatcatgcgttggagctgaattcaaaacctgtttttttttttttttaaagtagtcatttactcacatggtaattaaagcaaagaaaccaaatatacagttacaaaaattgtcagattccataaaatatgcatgatgaagaattgattaatgtacatgctaacccatggcacagtccctaaaatctagtcttgtatgtttaagatcatcctaagttgagtcctttgaaagtaaattttcagaggtaaagaattatgacatttctcagggtgcatttatttagtgagaggaaatccttttaaaatgattctaaaatatagagcaaaatttcctattaagtcaaaaaacatcctcactttcctaataagtgtcatatatagaataaagatttaaaaagagaaacttgcttaccaaggtattggccactgtgttctgtaagagatgcctatatgctgctgtttttgacaaactaagccttaattcaccatgatgaaataattattcagggtgagaaatgacacctatctaggactgaagcagaaaatgctgccaggatgacaggatgtgaacatttgataaagaactagccagcacagacagctgtaggcggtagctttttcacatgatcacccagcagattgttgatgagtcaggttgatgatgagcaactcgtggaaagtgactgtcctaaatcgcagtgaggagacttctggttttgcctggtctcatctcatcccttatttgctatgtagatgtaatgtctctgggcttccgttttcttaactgtatcaagaaaggattagagtaaatgataccatagctcttcagtgctatgattttgttgttgctgttattggtcgtgatggaggtttttaaatttataatgttattattttagacatacaagttcagatactaccttttattactactctatttttatataaacaaataattggagaaaataatttttaaaccaaataccatacattttagaaaaactttagctctattgtttttgagcatagaatacaactaataaacaagtttctcatttttttattgacatttatatattgcgtattttctaaagtctttaaatgttaataagtatgtatgtgttatgtcatattaaatgtattttaagtgttgatccagaaaatgtatttgagattagctatctactgcaacaaatagaagccctttgtgttaatgtttgggaagtagaatattattctaattaattttgttgctttctacactccataaaataatgacagggacattttagcttcttagaaagagactattgcaatatagatcaagaactggatcagtaaataaaaagaaagaatgtgctacattactttacacctcttaagaaacacaaataaggctgggcacggtggctaacgcctgtaaccccagcacttcgggaggccgaggtaggtggatcacgagatcaagagatggagagcatcctggccaacatggggaaactccatctctactaaaaatacaaaaattagcggggcatggtggtacacacctgtagtccgagctactcgggaggctgaggcaggagaatcgcttgaacctgggaggtggaggttgcagtgagctgaggtcgtgccactgcacgccagcctggtgacagagcgagactctgtctcaaaaaaaaaaaaaaaaaaaagaaaagaaacagatgtgtaaggtttgtctacttgctggaataatgaaactgtattaatatttcaaagtgatgcagaaatatgacactgtagagaataacctctcccattttccttagagactggttttcattagtgtatcttctcaatcattgctgcatatgaatacaatttaacaaaaggcagttgattccattcaaattactctttctttttaaaacttagattactttgttttacactggaagctattgctatcaactaaaaatgaaaactctttctagtaaacagtcatgtacttaacaagtgattccattaaagaaattcaagactgaggttaaaataagaaagatagaggaaggggaagaacttcagatgtagattaagaagatgatatatgcttgggtctcattggctgtgtgattagtttttaaagttgtaccagtctctgagacctccaaaaagtgtgttaacaagcatacccaagatgggcttatggcaaagtgacacattataaagctgtattttagaggttgaaatcaatcttactgttgccatttggtggcggttttaacctacaatccttgttttggtactggtgaagagtagtgtctgttaagtgcatgtgcctatgctaagaaagtaacctgttgttttatagaagtttctctttttgtttgtagatataatacattgccaagcagaagaactctgaaaaattcaagattagtgagtaagaaagatgatgtgcatgtctgtatcatgtgtttacgtgccatcatgaattatcaggtatgttggagcttctggttcttttaaaaaaaacctgaattaatcagactcagaaatgactgctgggtgcagtgtacaccgcttgggcgaagggtacaataaaagcccagacttcatcatcctacaatttatctgtgttaccaaaagctgcttgtacccctaaagctgttgaaatttttttaaaaaagaagaaaaaccaaccaaacaaaaaaaaaaacagactcagattttgttctctttggtttctttgtattatttctatttgaagtaaatgccaggatttaacgagattctattaaaaaagaaaggcctggttcatcctaattctcaaggtttaattctttgctctcatattttaataaatatatataatttgtgacgtatttaaaggaaaggtgttttcctcctatagagataaacttacctagattgcttggtgaatgcttgtgactactaaagattgaataagctgctgttgcaggtagtaatgaaacaactctagaacaccaggaatggatagagacagtggttctcaaagggttatatggcaaacaggcaaaaagttacaattattgacagttgggctcagtggttcctaatctttataagaagcacctagaagatcgttgaaaatgcagattcctcctttgggtaattgagatgcaggttgaccccactgtaaaaacactggaagttacggtggaacacgtgtgctgggttaatcttaacaacaaagtggaagttagagcctgtagtacctagcgtgaactggtagggtcatcagtttaattaggtcagcaaagcaggggtacaggggttccacttagaaaagtggaattcaaatatagaaataggatttgatttccattaatatggatgctacagtgggtccaagtagaagtgggagataaatacataggtcgagggttggtgttagagttcaaaccaacacaaaaggtgctgtgttaaatttaagaagggaaacatgcatttattctttccatttttttttgaactttgccagacggcccctgttccacataggcaactgagaatacagcattgaataaatctgtggcccagggaacttactttccagggaggggagacagatgaccaacaaataaattggtaaaatgtatatgttccagataataatgatgaaatgaaagctaatgcttacatgttacacttttcaggtctagtgcttttaaacctcttaagtcatgtaaatagccctgtgagatcaataatattactctccccattttactgatgaagctgggacacagagaagtttggtaatttgcctaaaatcacatagctagttagtagtggagtcaagatttggacccaggaacactttgaacccagagaaccattactaagtactgtagaaaaaataggaaataggaactgctgaaaatgtgtgcgagttttaaataggccagctagggaagggtcactgagagggtaacatctagtaacaacttgaatgagggagcaaagggagggatattaggggaagaaggttctaggcagagaaaagggcaagtgcagagaccctgaggcaggaatgtctggtttgcccaaggcacagaaaggaggcttggctggatcagaatgagtaagagggagaagagtagaagatgaagtcagatgtgacagggagtttgattatgtagagctttagaggccgctgagaggacattgacttcactatgagtggaaagctattgaatggttataacgacataatctgacacttgcatttaacatgagaccatgctggcttctgtgtttaggtttgatcttggccaggcaaaggcaagagggggtagaccatttaggaggcttttagcagtaatttaggtgagctttggtggtcatatggactaggatcataggagtggagatgatgagaggtggtcagattctggttttattttgatgttaaaggccacagcattggatatgagggagaaggtgagtagtagagggtggcaccagggcttttgtcttgggcacctgtgagatatatttgctatctacaaagatgggaagactgcaggatagatggatttgagggagatcattaggaattctgtttcggggattttaactttgagattccccttagacattcaaatggtgatcttaggtgcatggttggatatgccagtctggatttcaaggcagtggtctaggctggagttagacatttgagagtaattagcatataaatggcataggaagccaggaaggtgaatgagatcagtaggggtagactgagaagtaaagaagtccaaaatatgaactctagggctctctgtttaaatgtcagagagacgaagaaaagctggctagagagcctgaaaaatagccaagtaggagccaagtgaaggacatatttcaaggagaagggagtattcagctctgttagatgctgctaagtcaagtaagatgtggagtgaggattggccattggcttcagcaaagtgcaggtctttggtgatcttggcaagaacagttcattgggatggtgggggtgaaatgcttgattggagtggtttcaagaatgagcaggaagtgaggatttatactgagtgtctggaggagttttgctgtaaaggatagcagagaaatgagaggcagtggctgaacacaggttgtggtatcaagagaggtttttattgttacttaagataatttgcattttttatgctaatggcaatgagtctatggagagggaaaaataagggggaagggaggaatttctggaacatatgatgttcgtgagcagatgcgagggaatgggatggaggaaggactcatgggaggggttggccttagtttggagcacagaagagttcctctttaataggaggtgaggaggtaagccacaaatctgtgtggatagattgatgtggtataggaacttctggatgttttctctgatgagctgagagtgagttttgaggagaaagaatatagttgacccttgaattttgtggggtgtgaggggtactgatccctggtgtagtcaaaaatctgtatataactggagacctcaccagtagcataaagtctgttaacacacattttgtatgttatatctattgtatactgtggagtcaccctggaagcttaaaaactcaggtgccaggtccctgtaattgagattcggagtaaatgttttgtttagtcttccaggggagtttaaggagcggccaaggttaataatcactgggctagagcctttttatcattttaataaagagaaacatgtagttcatttgtaaagaatgggaagataatcttttgataatagcatcattgccgatttttttttttttttttttgagagatgtgggtcttgttgtcctggactcaagctgtaccccccgcctcagcctcctgagtagctgggactggaggcacaaatcattgcatctggcattcttgaaatttttaatagagaaatatgctctgacagtgatatactagagacataagtgcatttataatggtgtaagtttcattaggtagatacttcgggtttttggttttaaatcaatactgacagttccctaacttgtctcccaatgctttgtgtttctttttttttccatgttaattttagtatggtttcaacatggtcatgtctcatccacacgctgtcaatgagattgcactaagcctgaacaacaagaatcccaggtaagctgcttttgtagtacgcaagtctaaatctatctagagaaaacagagggctagtcaacacttaaccaagtttgactttggaaactttcaagtgttaatctctgaaataagattggctataaactctttggctgtgtaagaatttttccttttagccaagttacattcttagatgggccagagttgagcaactggtgacaattctagcccttcactgttctcctcaagcttttgttcttttgaggcctggtttccagcatccttgctgctaaatttggagaggatcaggttgccaggactcgggggccaggagagtcttgataaagatttacgtatatcagttattgctggaagctagctaaaaccaccatccttcgtctacacttcgcttgataactttacatatgtagctttaattactgaacgaaaatagaaaaataattgtagtggccagccgcagtggctcatgcctgtaatctcagcactttgggaggccgaggcaggcagatcacctgaggtcaggagttgcgaccagcctggctaacatggtgaaaccccatctctactaaaaatacaaaaaattagccagacatggtggcacatgcctgtaatcccagctactcaggaggctgaggcaggagaatggcttgaacccaggaagtggaggttgcagtgagccgagatcgcaccgctgcactccggcctgggtgacagggcaagactctgtctcaaaaaataaagaaagaaagaaatagaaaaataaaattgtatatgcagatttcctttcatattcaccaccttgtaaaggctagcagcagatataattcacatcacacgttagtcgtaaaagccagtcttcatcaattgtagttattttaatgtgctttccattttggtgaagtattctgtacttcaaatgtgcaattccttttcatccaatacctctctgtagacaaaatatctgaaaactgttaattcaaaaatctgtttataaattagccatttctgatttggaaaatgcaacacgaactatcaagtcctctttactgaatattattctttcaaacttcccctgattaaaccttttgcgactgtgcgattccttccttcgtttactagagtcctaagtagccatgcttctgtgtctctgccttctactacagggaagacattattttttaaaagacaattgacattgtggagtatcagaacagtttttgtttagaagttggtgaaagctgttattccagaaaaaaaatgaaatacttaagtggtcttatgattgaagaaacaatgctgtttctttcttgacattgaatttgaaaacttagagtgtatctccatgttctccttccaaaaatatttcagattgagttttattttcttgagtcaaagaaaatattcttgtgttagtaaagctagtaaagctgtaatccagctccttccagttgtcctgcgtaggaagaagaaaggacagaaacttgtattttcgtgggagatttatggatctgtccctacatgagcagatttgaaatgtagaacatgagtttcagttgattttgaacttttttttttgcaaatgttctctcactgtctctaaaaccagagcaaatacttaatcaatagtttgtttttcagcatattcccattccctttgtttttagcgtaccagtaaacatttttcatctgtattgtactgagtcacctgatgataggtctaagagattattcttctcagaactagttttcattagtgagtgatttgtctttttggtaagtataccttccaaatttgccatcttagacaaatcacatatgtagtagtcagtaaaggtttaaaaatgtactttgattaaactgtaccttagtaaaattttttaaaaatgtaagggcaaatgttttattctcatgtatcttggaaggaagaaacagctgactcatcatgccattttcactgatttgtgtttttcttcttcttgttttggcagaacaaaagcccttgtcttagaactgttggcagccgtttgtcttgtcagaggcgggcatgaaatcattttatcagcatttgataactttaaagaggtaggctacactatagttttcataagaatactcacacatcttacatttggacatctttgaacggaattatttaccttttcatttatcctagggcctaaggaatataatagttaatttctaagatctcactgagaggaatgtaatgaacttagtctaaatttggtatcttatttctaggataagttaaaaataatcacagtactctttttttgttgttgttgtttttgttttaatttttatgtttttagggaacatggaataatccagtttgaaaaccggttttgttacatgtatgtggttttcattggggttgatattggcacttgatcgtccaccatgcaaattttatgaactctttcatcacagttactttatttttgctggatgctatgaaaaacctggcaaatactggcactgattctgggagcgtgtaagcttaagtgggcttgtcacagccaaacaataatgcaacagttgagcatggttggaaacggagactgtctgaccacaaagaaaggagggattacacaaagacaatatgacgccgcgggccctgccccagcgtatccaaacatcaccgccgcgggccctgccccagtgtatccaaacatcaccgcctagatagtagctgctttcccacagggtagtgggcagtgttgtaggaccaagaagagtacctgtttgttcccctggtatatgcctgacatcagaggctactttgaggtgagaaattacaaagtagtccttagagaacaggtggaagcccaggttacaataggacccttcgccaagttgtgtgttatgctagaagtcccatttaattccaaatgcttttggattaagacccgagctggattaaaatccaggtcacagagggactgttttctctcctctttcctgaaaggttctgaactagaaactctgatagtatttattgagaacctactatatgccggggctataccagctacatgcatggcatcatttggttctataagaacatctttgagacaaatattaatatcttgattttagcgaaattgaaatacatagtttacctgtggtcacatagctagataagtgacagagccaggaacaggacttggtgctcctgatcctgaacttccttgaaatgtgttgaagttgtggccttattgtttgtgaatcccttgaaggaaataagggaaatactgaaatgagacaggacttcggagctatttcccctgcctcctacctccttaattggatttactgcccagctgccaaatgttctagacaccagcctgtgagcctctgcataggctgggaagcttcaaagatgtgaacagggcagacactcctcttgctcctttatttgcattgcctccttactgctagtccattctttaagattttgatattatccattttgtaaatgccaactgtggagacaaccaaatattatctttttttttctttctattgagccccaaagatagtgaaaaaatatccagcttccaagagaatgaagaagaataatagtgaatctttaaattcatattctggcttccaagacaaatagattttagagacaagaatgtacgaatgcttgtctgtgaatgtttttatatatcatgtataaatatataaattttacatttataaataaggaagtatgtttgggtggatgggtttaatatgaaagagaaacagtatgtgcagctcatataacgcccaaatctttatcattaggtcatatttgaaaatattgcatgctgagtacttttcacattggaaacatttactatatagttatcagtggcccttgttataatgactcatattataacaggaatctgattatactgcaggtcagattatatcctaaagatatatttgtatagaacaagaataaaagccaggaattcatgagatgaatgataatatttttttctcctaggtaagatagagtacctttcttatgcatagtaggcccacagatacttgcagaattgagttttaactctttggtgtcagacttatatatgctttagctatttagggtgtagtatgtgcttaattgaagaaaaatgtaatcctaagtctaatacctggacaatagtaatgagaactaaattacttttgacattgaattcttagagctttaaccaaaactggcctcatttctgtaattaatcaggagtgatggtaggtcttcaggtactgtccttggcataggcatttgcatctgatagaaggtgatagcagtgggctaggggaggtcctcaaatgctggtgggaccccaaaccctgctggtgtctaggcgcttgacatcctcacaagaatgaattcaagtatgagttagaaaatagtgaaagtgtggagatttattgcaaagcaaaaagtacacactcaagaaaggggagtgtgggcatgcttgagagagtcacacaaggtggtttggggctgctacctttatggatttctttaaccaagggatggagtattcacggagattcctggaagaagctggagatttctcagaactatggtgctacccatttttacctcaaataacgatgttctggaactgtcatggcactggtgggtatatgattgaatatgtgaatgagcatagaataaggtcctaggagaaacctggatcaaatccagcaccatgttggacccagtttgtctttgccagcttggcccacaccctgtttttcagggtcttatcagccccaagcttctgcagctatttcagcagtttccttttgcttagtcatgtgaaactgctgcctagaattttttattctgctgcaaccatcctgcattattcttgtctaaaaaccatatagacagaccaagcaaatggattattatcctaatagccatgggaatgaagacaaggtagcaacatgcccccgacaaacttagttgttatagataggtcagaagagcctcaaccgatttatccaatcttgaggtgcaaaaggtgttattctgtgttgatcttgctttctaaaacatgcaatgccgctcacagctcaaagtctcttaaatcccttcctctttttctcccatctttgcgtgagtgaattttttttttttcacatcatagtaaagtgaattctttaacctctttaaccaaaatgtcattggaatcttctggttttataataatattcattattatattctggcatgcctgtgcagatagggttttgttcagtgaataattccttttgagccacatatggcagagagagtaccataccaggtaccaggataccaggaaggaggaccaaagaagagtctttgccttcgagaagattgtttttaaagcttttcatcttttttagtaagttgggattccattcatctgcctaagaaggatgaaaggattatctttgtttttattggcaggaatgaggggtgaagtaggggagttcaacatctattttttgcaaataaagtaatatgctttagagtagccagatcctttgggctttgatcactgttagagcatagccaagcgtactaacgcaatatggaaccagatgctagaaagacatttaaaaggccatgtatcttaagtagtttatgtagcaggatttttccccctctacctcttgagccaataaatccattctatctaatttgaccaccactaattaattagttcagatgtaaattaaaggaagttattatttggctgttgaaagatttttatgtatgactacatcattttctcatgttttgatgaatatttagaatcccaatcttatattttttttccttaaaaaatcttgctacaaatcttgtaatagctgaagtgcatgttttaggaaggcagggagcacctttagtttaatggtatgtgatggtggcaagaatgttaacccaaagctttgcttatggtgggggtgggattggggtctaagcctgatgtcactgagcaaacacatacatggcttcaatgtacatgatgacaaatgagtcttaattacatgaatacagatagtaagcttatactgtgcgtggtttgtgacatgcctgaaaacatgagtgtattgagtagatgaagactaaatcattaacagtcaaccattgtgctccttgaattcttttttccttaaaaaacaattttttaaggggattaacacatctggttttgtgttgaaatatctcttaacgaaaatttatggtcttgaaataaagaccagggtgagaaaaaggagtcatctattttttcttattggctaatttattaatagccccatggaaggacatatgaccatcttacctaaattgatgttttcttagttgtgtggcagtgtatatttttgagccccgagactaccaaacagaaaaaaatacatttggaagtaaaaaccaccctttggatatttatattagttcagagtcttctttgcaagaagcagaaactgactctaacacatagaggaaagggttgatcgaaaagatgttgagaaaagcacagacttgacaaggagcctggagaaccaggcttggaaaatgggcaggcattcctaaaatgtggctatactctggctctgcctttgaagctgcgccaccagaaataccatttggggttctggtcatgctttttcttctcttccaaatgacatggaccatagctagcaatctgctggctcataaaactcttatctactggttaaggacctcaaccagtccccacttcagatttctaaacactacgcttcatctcattaccaaggggaaccttgaagtcttcaacctagctcttgctctcaactttttcttagtctttttactttttccattatattctttgatatatttgagaaaatggcttgcttttaaaaagtgtctccaaaggtttggcaaaaaaaaaaaaaaaaaatgcttccttctgaagtcaaagaggaaaagtactgaggccctgtagactctacagtggaacagccactatgacatgagtaataaaatcctctgagggctttgaggcaccagctctcccaggctgctgggaggtgcacctggaattcatcaggatttcggatcaattataactgtattctcatctgcttctgtaatgacagcatctggctttagcaaaaaagcctgagtttggttattaaaggctcaactccctcccacttttgaccttccagtacagaaagatggagccttgttgaatgagtcactcgaggccaccagcactcttgtgcacagcactcttggcagtagttgttcttttttctgcctgttgctagaaggcttcctaagaaagctgatgtgtggtttagctactgggcatctgaaggcactcgtgctacacattattaagttgaactaagaaagcctgtcaagttttatttatagtggaccaaattgggcaggaaggagagtgaagattttggtgtgcttccagcatccctctgagtttaatcccatgtaatctaacctcccaagcatttgagggtataggattgtaaatctagcatgagaccatccagataacttcctaagtggtaaagtaagggtactcacatttttcagtctctcattgaactataagcaatgtattctctcaagtctcaaactgtaggagccacagccgtagagcatgtatgtatttcatggtatcaggccagaattagattgatctaattaaccaagattcttcttgactggtcctcctccttagcattaggaagcaaagtcctagtcttaatgtggtgttagtgctgctgagtaactttttttgtctgtttatcaactgttgcaattttttgctgtggatacgaaagtaccccacacttcatttttttaggctcctggcttctgtgggtcaggaagccaggctggcatggcagggattgtctcttctttgttttgtctggggcctcatcagggaagacctgattgactggggatgccagtccatctggaggctgtttcacccacatacctagtttttgagctatgatacctctcaaggactgggcccagctgggactatcaaccagagagcctccatgtagaactccacgtggcttgggcttctcacagcatagcatctggcttctgagggagagtgccccaggaaggagcatctgaagagccaccattcaaagagccagaggctgctgagtgtcttctgagctggtcttagaagccgtgtagtggtcacttctgccatgttatctgggttcccagtgaggccctgagcccaacccggatgcaaggggaaggcaatggcttctcttcttgatgattggccgtcgggttactgtgcagaacatgtggggtgggagagagagctgtgggctcataccattgtagtctgtatacctcagtaagtctcgtacctcagtaactgtatgagatttaccaaaatgtttattgttattcgtctttcattttctccctcttctttactcaatccaatacttggtttttccttttgactgaaaactttataaactttttgattggagataaaaaagatagtttttaattctttcatgtgaatctactatgggcaaatgatattgtgagagccttccctagagaaaggagccattttcataggatgtccaagtttattttctggtaatgaactagttatttctttaccattagtgtctttaacatctggttaagggaatgaaggctggtatcctcctgattgttaagggatgagtcatactcacttactgaaaaaaatgtgagtgctttctatgtgtcagaaacattgataaatattggaatatgaaaatgaatcagacatatgccctgcctttaaaagagagcctcccaggctagttgaggaagcagataaatacttcgacagttgtaataccaggctttataaaggtaattgcaagatgctctgcaaagaagaggaacagctgaccaagacaaagtagggctggaggcagatggggaaagagctctcaaggaggctccttataggagagggtgcctgaacagagtttagggtgaacaaggttaaccaggtgtattcctttcccattgctgctgtaacaaatgactacaaacttagtggcttaaaccaacaccagtttattattctacagttctgtagaccagaagaataaaatgagtgtatagggtggtaatctctgaaggctccaggagagatttcatttccttggccttgtcagcttccagaggccacttagattctttggcttccagccccttcctccagctttaaagccaacaacatagcatcttgtctctgtctctctgcttctcttgacacattgccttttctctctgacttctctgtccttcttcctttaaggacccttgtgatgacattgggcccatccataataatctaagacagtctcccctcctgaagtcccttaatttgatcatacctttgcagatatcatcatacctttgcagatatgatcaaattaaggaacttcagatggggagattatctttttattgtataaggcagcatagtcaacaggatcaggaattagcatgtggacatcctggcgggtaggaggaacacatcattcagcctgtcacaccagataaaaaggagtgaggatgtcattttataccaagaaggtagtattttaataaagcttcaaggactttagtttgccccgaatctccagttttaaagagcttagggcatgggaagagaaaaattgggataggaaattaaagggagatcagaaaaggcccccttgcttatcccaggctcttcatagtgccacacagcctaaagggagcaaatatgctccccagtcacattggctgtttagattgactctattaataaagaatttgctcatatgttttgttctgaaagtcaattaacagtgggctcagcatgcagttgctttgatagagcagggtgtgtttggggtctgagatttgtttcagaaatcttaccattcatatttctcattccttgggctcctttctccaccgagagtcatctgcttcatcagctgccgtattcatttacttatcacgtcttcaggactgcccttttttggtggtcctgggggagcttaaaaaaaaaaaaaagaggaagtacagcagggtaacagtgcccagagccagaccagattgtcacattatctgttgtacaaatgtagagatgctttgcttcacaacttgactttaattagaccccttctgctccacgcaagcctgagtacaattttatgcaatagggaacctcatcctctattttaaatgtagcagccacttaaaaaaacaaacaaaaaaaacaacaaaaaaaaacccagggtgttagggtgttgctgccgtgttatttctattcctataaaaatgccgcttctaaaatgcatgccctttgccaactataaaagttggcatatgtgcccttatttcatattcttggaagataacgaggagaaccccaagagaaagcagtgagagctgagtgttattttaaaccctgcagaacttgagacagagactggtactgttccctaaacatgagctttcacttgggaagtatttctttgacgttttgatattgtctggtttaaggtacagaaggacactatgaagcactctgctgtgagctgatcagaaaatcggagtcaaaactatgacagctttggcaatatcaccaactctaaaaagcatttgaatggaagttttcagtctccgggcaggatttgattgccattctggcatttatttcgtgaaaggcctatttaaggatcttcttggtttgctcttcctgtgtaaaggagctgcttccctgctcttctactccctcactcctggacctcctgggctcaagtggtcctcccacctcagcctcctgagtagctgggactacaggcatgtaccaccacacctggctttatacatatatatatatatatatatatatatatatatatatatatatatgtatatgtatatgtatatatatatacatatacatatatatatacatatacatacatatacatatatatatatataatttcttgtggagacaagatcttgctatgttgcccaggctcattttgaactcctggccttaagcagtcctcctaccttgacctctcagagttctaggattacaagtgtgggccaccatgtctggccttctagctgctttttaaagtagttttatattgagtaaaaataaaaattattgtttttatgtgtcatggaattcttgattatagcttattttagcagttatttagtccagtactaagccctacacacagggttatattaaccgtcttattaaataagcatgtgtggctcacgcctgtaatcccagcactttgggaggccaaggcaggcggatcacctgaggtcagtagttcgagaccagcctggccaagatggtgaaaccctgtctctactaaaaatacaaaaaattagctgggtggcatgtgcctgtagtcccagctactcgggaggctgaggcaggagaatcgcttgaacctgggaggcagaggttgcagtgagtcgagatcgcaccactgcattccagcctaggtgacagagtaagactctgtctttaaaaaaaaaaaacctgtaggttcaactatagctgttcaaatagttatgaagtgctggatatgttaaccaggaagaaggataagataaatcatatataaataatatatatgtgtatcagtgtgtatgcatgtttgtctgtatatttgtacattaaatatatgtgtgtgtataataggagtaagtgtaaagatatatgtgtgcacagtaataagccctaaaaggaagcaaatgagaggatttggagtggcactgggacaactcctttgtgtgtgtttatttctgttgcttggactgtttggtaagtaataatccctcacgtggctagactatccctcttgtgcagagttagattttccctctgataacttttttttttttttttttttttttttttttttttttttttttttgagacagcatctcactctgtcaccacccaggctggggtgcagtggcgcgatctcagctcactgcaacctccgtctcccgggttcaagcgattctcctgcctcagctcccgagtagctgggactacaggcgagtgccaccacgcctggctaatttttttgtatttttagtagagatggggtttcaccatattggccagactggtctcgaactcctgacttcgtgatccgcccaccttggcttcccaaagtgctaggattacaggcgtgagccactgcgcccggcctccctctggtaatattttatatggctagatttgtcttttctaaagatgctcagttatcttttgtgtaacatctctccagactaccaccttttcttcaaaactgtgaaacagaatcagaactgtttggaattgccagcagactgttgagcaaatatactttttacagtgaccccgttacagggttaggggagtttgttagaaaataaaaggtttcaggccaggcgcaacggctcatgccggtaatcccagcgccctgggacaccaaggtggaaggactgctatagcctgggagttcacaattagcatgagcaacatggtaagaccctgcctctacagaaaatacaaaaattagccaggcatgttggtgcacgcttgtggtccccggtactcaggaggctgaagccagaggattgcttgggtctagggggtcaagactgcggtgagccgtgatcacaccgctgcactccagcctgggcgacacagcgagaacctgtctctaaagaaaagataaggcagccaggtgcggtggctaacgcctgtaatcccaaaactttgggaggctgaggcaggtgatcacaaggtctggagttagagaccatcttggccaacgtggtgaaaccccttctctactaaaaatacaaaaaataagccgggtgtggtggcacgtgcctgtagtcccagctactcaggaggctgaggcaggagaatcgcttgaacccgggaggcagaggttgcagtgagcctagatcgcgccactgcactccagcctggtggcagagcgagacttcgtctcaaaaaaaaagaaaagataactcatgatttccgtgccacagaagtttgtattgccttgagaaaggtaggactgactttaataggtatttagttgaggaccaaatatacactaaggtcaacactaggaggacagtaatttaaaactttaagaattgtgcatgtatttatatttttatacctaattgtaatttaaaccaaaatgttaggtgttattgacaatgaatgtgtgtattgagcttgactctctatgtgagtcaagttcaaatttcatttgaaatttaaactcttgtaaaacataagcacattttttattgatgtgggggtctctcgtcaataagggctttgtttgttggtttcttttaaaccagcaattctcttcagaaagaaagcatgagcagagttcagaatcaattccattttcttctttattgtcaacattagtgtatttatgtcatgtacataaaaaggcatatacatatgcagaaatagtaaggctactattagttaattttctatttaataaaaaatttgtttgtttattgtttccttagtgctggcagactagtatatattattttgttaattcttagatgcaccatctgaggtaggaacatagagggagagctcagagcaaatgggcctactgacgtctctagtaaatggcaactctgggatttttacacagatccatttaactcagagttcatatacagccttacataacatgtctcacattccaggcactttccacacatgttcgtatattgtcctcaattttccaccgaaaagcaaacctaatgggaatggttagagattggatagattattggggtgtttaaaattactggtaaaattcagaacagaccatactgtttgtacagggcccagtgggagaagtgggtaggtcctgagcagggtgatcaggaagggaagagacctgatttgatggagagaattctgggagcagagagattggcatgaaatctgtctcaaaggcagcataagtcagaatatatttgttctttaaccaggaaaaatatctgaccagggtccatgttacagaacaaaacatggcaagaggcaggcatgaatgaggttctgaggaaacagtggtggagagactggaaacctgtgattaaaacaaacaaacaaacaaacaaacacctcaactagaagatagatacaaatagaagggaaaaaagagaaagggaagaaattcacagttacataatactttacagtttagaaaatgctatatatatatattgcatttgattctgtggaaatctgcaaaaagccttttatgtaatttggataaaactttaggagtattgtgtagctctgcagaaaatacagtagaggggagagatgctggagtctggaagacaggtggttcagttgtcaaatgactcagccttggacccagtttgtggccatggcaatgaatatgaagccaaaaaatgaaagaaaaggcaataagagatagggtgatccaccgaatatgagaatggacacgaggagaataagaatctgttcaaataatatacacttaatgaagaggaaagtagcccaactatagtcaacaaatacaatctggggatttcttttttcaggcaaagaaaataaaactttttttttaatttatttttttagtgggggtgtaatgcccgaggtcagattcttagctgtgcaatgaaggtaatgaatgagagaacaagtttaaacagaggtgactagggagagagagagagagagagagagtgtgtgtgtgtgtgtgtgtgtgtgtgtgtgtgtgtgtgtgtgagagagagagagagagagagagagcgagagagagccaaatggggattgtaactaagtaactaaggaggaaaactcccccacagggaccccagtccagaaggaaaagagtgaagagacaaggttagaatgggctagaaggatgctcagaagagaccagcacagtacaaaggggaaggtggtcaagaggatgagaggattcctggtgggtctggtatattgtgatgtaagtttttgctttaggtgagaagttagtcaagtggtttttatatatcttccaagtctacaattttatgattctatataaaactttgtgtacacatgcctatgtatgtaacatgtattgtgtgtacctattcaaatagttccctctaagaaagattaagtgcttctttgactgcagatatgaaaacaaggtacctagataataaaatgataggtgctttcatttttcaaacaagaacaaaaactgacatgtttgaggccagttggcaggagagcaacaatcctaaaagagatcactatgactgcagacagtattgtgacttccggcctaagttcccttttatgactacttggaaggtggctgcgtcaatcccttggctcaagtttcatttcaaaaatctgccatgtgtctaaggacgtcgctgtttccctagactgagagtgagctggctgtgctggccatgctgttagtaccaccgcacgaggtactgttgaggacttgtctgtggaagaagcatccctggcttgtgtagcttttgaaagatggagcttttgagtcttgatttaagcttttagtttcccagctcccctgtcctaccccaaactgttctgcccactgcagctcaacagccattctttattcctttcaacacagtggtatatgtggctactgcccagctctttaattctatgtatcagtctgccaagaatatatagtcagactcggttttcattcacaattgactgaaacacactcactagaagaaaatagcccagtggttcctacttatggtccaacagtcactgtcagtcacccttcatcttgcagttgagctctctgacaagatgttccccgcaaactctgcgtcacaggggagtggaaatggccagtcatggtaacatgagctttaggctctgtgttgttttggcagtttggttttggcagtggaaaataagggctccttccctgccaataactgtactagcaacacatgtgatatcccagatttactggttcaccaccaagaacaacactgaatttttcatttcattttcaactattttccaggaatagatgtaaaattagtaaatggtgctttctatgtggaacgtgtcaagaacatgtttagcacattggtaaaagataatgatctttttgttccttgtgtatttgttcatgattgattgattgatttgattgttgttgcttttgaggcagagtcttgctcttgtcacctaggctggagtgcagtggcgcaatctcggctcactgcaacctccacctcccgagttcaggcagttctcatgcctcaggctcctgagtagttgggactacagacacgccaccacgcccagctaatttttgtatttttagtagagacggggttttgccatgttggccaggctggtctcgaactcctgacctcaagtgatctgcctgccttggcctcccaaagtgctaagattacaggcatgagccaccatgcccggcccatgattgtttgatattatggtgtcaggcgtcccagacaaatttgtttacttgggtggattcattcagtatgaatttctgaactttgaggaatgtgtgttctatatattttttttcccatgcggaggagatctctttctgtccctttcccatattcttgcttgaaatctaacattcacctggctttgggaaaagaacatcttctagccttataatgagtctaatgtgacagagtgggtacatcccagagataatcagagaacagttaggggctgtttccatccaacctgataagtaccagggattgtacctggccttattaaacagaagaattgcaaggaagtctttttttttttttttttttagaccaagtctcactctgctgcccaatctggagtgcagtggcaccatctcggctcactgcaacctcctcctctcaggtttaagcgattctcccgcctctgcctccagaacggctgggattataggcatgtgccacaacgcctgggtgatttttttttttttagtagagatggggttttgccatattggccaggctggtcttgaactcctgacctcaagtgatccgcccacctcggcctcccgcagtgctgaaattacaggcatgagccactgagcccggctgtcttttttttctaccttggaaaatggtggagggctcctttctatatgaagacactattggtctctgtgtgatgtggcttcatttttatgcagagatggtacatttagtagttctttgtatggtatggttgattcccaaacaatcttgcaaggaattttactattagttatccatttatttgcttctttagattttaggtttaagaatccatcatctttgtagaaatagaggctattctgtaatccagtagtttccaacttttggcccctggagccctttttatgctcttaaaaatcactgaggtccctaaagagcttttgtttatgcaagttatatgttgatattttccatattagaaattacaacaaaatttcaggccaggcatggtggctcacgtttgtaatctcagcacttagggagattgactcgtagaagatagctgcattcttagatctgcttctgcgtttagtcacttctgctgttgtttttgttgaagtagatgaagaaaatttagcctcacacagatatgtagatgaaatagaattatgtcaacagcattttcagataatagtgggcattcttctttgatactatacaaacactagacaagtagtaatttcttaaaggttagtcacaaagtagaatccgaaatcgtatcgatgaactttttccatactgttgcattaaaatctatttgcctatattgcaccttgaatgaatttataaatttgtaacaacattcagtgatcattgggaaaataatggtacactgagttatctagatcttctaataattggcacatttcctaatatactattttaacaaatcacatgcattatttttacctccaatctcattagaaaattctttaaatactgggaagcagtcagactcctcgtggtgggtacagttttcatgtgtttgcttaatttttatcattgataacaaatattgtcagctgttatctttaaattaaaaggtgcactttgttcattttcaagaaaatacctgccaagtgcataagtctgaatttgtcagtcatgctttcaagtaagaacaaagagtggctagttcatcttgcaactgaaataatcacagaaatgctttttcctcaagacaaccatacttcaatatgcggcagaaatgctttatgcagactccccatttcatcatctagagtatcataaagatgtgtatctaggggttgagatgtataaaattaataccttttactgcttcatcaatgatattcttaagtgaaactggctttttaaaactgagaatgcgtggctgtggtgaatacagggattactggtataatttggtgcactgccttgatgcatgctatggcactggcagtattcactcattgttccttttgtgccaccagtgccaactgccaactctgtgaaagtattaagtaacatcttagtagtattatacaaataatgctgccctcacaaacctcataaaagggcctaaagtacccttggtgttcaaggaccacactttaagaactggtacccaaatccattctctgctgtcatcttgggctgggtggaagtggttccaattggctaagcgcaaaatccttctgcttaagacccagaggtgactgtgggtgttagggtgaacttggggaaaagcaaagatgaaagtagaagggttgggaaatgagagaagcgagctgtagacaaactgcaggcatttgcctgttgttggcctgagatatttggtctatccaagagtccctgtcttcaaggtctctgcattcatggcacaccatgcactgattagatttgtagtgatttaggtgtgaggagagcatgggctgatagctgcctcttgcgcaggccccaagatctgaaattgctgcaggctttagacagctctagccacgtgctcttgctgtggtttagagaacatgcgataacccctagagatgtcattgtgtcccttcccttgctcagcttgacctaattggatatgctcaaaggatgaagctgtgaagagaaatgattgaaaataaagaacagtgttaggctccttcaactttgaggggtctgactggtaagtcatcccagagaggactgaaggcctttgtcatgtaatcctcaggtggctatttaaataccattctcaggctgggtgcggtggctcatgcctgtaatcccagcactttgggaggctgcggtgggtggatcacttgaggccaggagttcaagaccagcctggccaacatggcgaaaccccgtttctactaaaaatacaaaaattacccaggcctggtggcatgtgcctttaatcccagctactcaggaggctgaggcaggagaattgcttgaaacccgggaggtagagattgcaatgagccaagattgcgccactgcactccagcctgggtgacagagcgagactctgtctcaatcagtcagtcagtaaatatcattctttattgaagaaatggaaggtattttggctttctagtagaaatgggggtgtattagggctctccagagaaacagagacaacaggacatctatagatatatctgaagatataagaggaaacattatgggaattgctcacgtggttatggaggtagagaagttccatgctacgcatctgtaagctggaaatccagaaaagctagggtgtcattcagctcaagtctgaaggcctgagaagtaagagcaagtggtgtaagttatggagtctgaaggcctgagaaccaagagctccattgtccaagggcaggggaagaagatggatgtcccagctcaagatgagagagaattcacccttcctccaaattctttttgttctgtttgggccctcagtggattggagacgcccagccacattggagagggacgtcttctttactcactgtcacagacacacccagaaatatttcaccagctcttggacatcacttcaccgtctcaagttgacgcataaagttaaccattacaagtagccttgaaagactctatgtgtccttcctaatgaccaggagatgtgagtcttgcattgaagctagagaggttcaggctggacttgaagcatatttcggaaagagatcatttatgacctattgtaaggaggagttttactctctagaatttattgaaggtcatcttttttttttttttttttttttttttttttttagagaggtagtaaaaagacatttctcattgaaggggtgatgcgtcaatgagtcgtcctttggggattttacgatccttttgcttctgtctttgggttctttattcagtacagcaaaatatgggtgtggaaagtaagacagtcatctggctgctctgtgtgcctcctgccaaacatctggatatctggaaacacctggaaaagttactgaagttttcacaagggtgtttagcattatgcgaatgaaacctcaggctcatagtcatctcctggtccaggattgatacaaatgttgtatttatgaaggaggagagttgactaggttatagaatacatttagttgcttagctttcattagtttttgttttagcggagtgagataaggttgttcagtttcagagcatttcagctggatgaacatattcacagttaaatcccaaggagacatgagagccagcagcaggttggagtgatctgcttctgtcatggctgctgcatggtgtatgtgtatgaaatgtccaatcacttcaagagacaacaataacagaccattgacagccacagaacaccccagaaaagtggttttgtcaggccattatggccctcatatagccctcagactgctggtgcactcagtagatggtaaaagatggttttcacctaggactaactatgaaataactgtttacttcacaaggccctgaaaagaaaacagaacttttgttctcaggcaggccccgagaagggtcgtctaatcagtcataatagagtgtgcctctaaaacggtgccttcctgcagggagccttgcagatcacaggggcctattgtaagaggagaaaaagaaagtattgaggcaggcgccaggcaacaaggcaagaaggaaacacttaagcaaagggcctttaatttttatataactaacccagaagcatattttatagccatctcataagagtcaggcctcaatttggctacagactttgcatggttccctgggagctgttgctggggaaagccagagactgttactcaccttgaagagggacagagaggtggctgaagtctgggagtgtgttcacttcaacatctggctggcaagataatacccaaggtttttgtaaaaccatctcctctccactattagcctttagggaaagcatcccctaaccgccgcccaccctttgagatgctttaaactatagccacctttgcctccagggtcccagattgatccaaatggtttgggacactgttcacaaatgtctttcacagatgttggagagcatagttggagctttttttttttggcagaagttttgcttttgcttcaattctcctttacatgaaaatgaatcttgcttgtcctgggagtggcccacgttatctgtgcagggtatgggatttcatagcttcacaatcaggagtgaaccagatggggcaagagagtggtttgacctttatgtttggtattcagggccagcacagccaagtgcattcctctgaatttgtttctgtggagcttccatgccagtcagcttggccatatcatgttctattgccatgctagatgagaattttagacgttcaagaatactgagggagagaatttttttcaaattttttatttgcaatgaaacctttttttcccctcaaaagcaatcttatcagacaactaagtaagtataagaaagaagatctggatagtgagggtagaattctcaagaaccttacttaggctttccctttctcggccaagcccctgacttggaattcccccttactcccaaagctctgtaacccatatagtttcttctcctttatttcctctgtaaccctgatggctttctttcttttcttttcttttttctttttttttttttttgagatggagtctcgctctgtcacccaggctggagtgcagtggcacgatctcggctaactgcaacctccatcccccaggttcaagcaattctcctacctcagcctcctgaatagctgggattacaggcgcctgccacgacgcccagctaatttttgcatttttagtagagactggttttcactaccttggccaggctagtctcgaactcctgacctcaggcaatccgcccaccttggcctcccaaagtgctgggattacaggcatgagccaccgcgccggccgattgctttcttaaagtatggcttgcaaaccagtagtattatctaaggctctcttttcttttcttttctttcttttttttttttttttgagacagagtctcactctgtcacccaggctagagtgcaatggtgtgaccttggctcactggaaccttcacctcccaggttcaagtgattctcctgcctcagccttcctaatacgtgggattacaggcgcccgccaccatgcccaattaatttttgtatttctagtagaaacggggtttcaccctgttggccaggctggtctcaaactcctgacctcaggtgatccacctgtctcggcctcccaaagtgctgggagtacaggtgtgagccactgcacctggcctaaggctctcaacttgatagatgtgaaaactgaagtccagggttgtttgctgaatggtccaagctaacaacagggtagtggctgaactgtgacttataacccaggttttacagtcttgtctaatgtgccacatagtcccatttctacccttatagccctttacccccatcagtcttagagcttgaaggtgcaaagagaggcagttgtattaggcaggaccccacagggatgggcagataggtggctgtgttagcagactgaagtctctggtccaggattggagcctgatcatttttacattaactgggatcgtgaatttattcacttgcagccggtttatagatgatttataatgaagatgcctcttggttttcagtagggtacatacttttccagggcatatacttttatttgtctgctggtttacttaattgctggtagccccagctgctagcagtagtagtctaattcctgatagggcagtccagtgcacagaagggctccttgccgctctgctcggctcagtttttctgtagctcttaaactttctccccaccccacttaatagagtacatgttattgatttggaaactggtatcaaagctggtgggagaacgagatataccagtgaatataaaagtcaagaatgacacgtttcagctgcaagaatatagcttttttattaaaaagtttttgcaccgtgtattatctggcctttgtgggcagatggaagtgatgcccatcaatatagaatgtgtaatgatgtacacgtgcaaatatgctcctggctcttagaaacgttttgatgaagcgctcgagttcattcccatgcaggccaatgcatggattctgaaaataactgaaaattagtgtctcgttcctttcatcctcaccgattttctaaagaggccaccgcaaaggagagagcatgttccaccatgatggtcctgtttcacccagtgcgtgggggtgctccagatgtgagcagtatgaacgaagacaactttcctttgatgtgggacacaacttttaccaaccttccccaaacatatcttcctgtttcctgtgggattgtagtgtacacttgtttaatgattgctaaagtaatggagaaacaaatgtgaatctggcctgcatgcttcctttccttcctcagaaacaaagtggggctctggaatccttgctgtgcctgtggaatgtgtcaggaaacacaaccctgagttcattagttgagattggcagcaaagcagccttgggtctggtggagctgtggtagtaggggtccttctagtccttaccatggagagtggtcactctgttgctttcaaggtttcccaaagccggcatttgtattcataatgtcattttgtgcatttgggttattttcgccaagttcatagcagctgtaaataagaagatatttaagtctgtttttttttttttttttaagattagaggtatttctctgttttgtaacgcacatgttctcagtagggatttgtctgttgacagaatgagggctctctaaagaaacacatatattcaaggctcttcttaacatctacttcaggtctatctgccaggctagtgatgtgttttttgggatccttatccaccatgaaatctagtgttgcttgttctatatttgatgccatcttttaaagtaacaggctatgagtagtttgttgccgtccacatgtgcttttccagccattcaaaaccttttttttctaagacccaacatgcaccccttgattatttttgggttaccttattattcattgcacttatgcaggggcagtgggtccattcctgcggcattcctatgatatccaattatagtaactgtgtttgtgttgctcagttagaagttgaatgagctggagatttaatgatctagttaatcagtttataattggtaatcagaaagactgagggtttaatcagccagtgtgatatcatatgagccattggttcccagatgctggtccaacaaccacaagtattcacagatttctaggcccatctggggagattcttattcagtatgtctcaatatagactctaggaatctatcatttttcgaggttccatggaagtttctggtgcagggatgtcaaagtatgcatggtataatgactatgtcttttagtgataatgtttttcatctctgtgtgtctcagatactgctggaatgccttaactaccttctttaatggaatatgtttatatgggcattctgggctatgtgggagaaggaacctcaggctggccatcggggacctggttctagccttggttctgccactctctcaacctttcatcaggttagagaagtctaatctctgtgtaggtctaattcataaattgagagcatcagattatgcaaaaggcatttttcagctttctaacattcttcgaagagctttgcctccctaggaattgcttttgttgtcactgttcacgaacagctgttgcctcatttagtttagcgtgtgcctagcccctcaaccaaacatgaatcacggtctgcttctcaggagagctggtagctctccccgaattcaggatggcctcttttcctcttctgttactgccactaccaatcacccacaacaagaccaaagtacactgttttttttttgagacagagtctcactttgtcgcccaggctggaatgcagtggtatgatctcggctcactgcaacctctgccttctgggttcaagcaattctccttccacagcctcccaagtagctgggattacaggtgcatgccaccactcctggctaatttttgtatttttagtacagacggggttttaccatgttggccaggctggtctcaaactcctgacctcatgttatctgcccacctcgtcctcccaaagtgctgggattacaggcgagaaccaccgtgcccagcctgtattggggtttctgctaaagaaaattcacattgcagttctgacctttcgtataaaacctcagggttttttacccacagatccctttttgcaggcaagagatgcttgtctctttgggcgtaagatgtgactgatgtcatagtctagggagctgggcctgtactgcctcacccccttcaacaaacctttcatttccaggaacttgctgtagattgtctaggggggccagctgaggaggggggcagaacatggtaaccccttaaatctctggttgtcagccattgtggagcatcaaaatgatccatagtgcttttaaaattgtgcatgcccgtgtccccccagcaccacctgggccaattgaatcagactctccagtgtgggactggtcatgtgtgtgcgtctgtgcgtgtgcgtgtgtgtgtgcgtgtgtgtgtgtgtatttttgagacagggtcttgctctgttgcccaggctggtgtatggcatgatcatggctcactgcagcctcgacctcatggactcaaagtatcctcccacctcagtctcctgagtagctgggactacaggtgcgtgccactgcacctgtctgattttttaatttttattttcagtacagacatggtttcattattttgcccaggccagtcttgaactctggggctcaagcgatcctcccgctttggcctctcaaagccctgggattacaggtgtgagccaccatgttaggccaattttaaagactttactttagactctaccttccatgcactgtccctctgcattctgaaattattttttgttaagtcaggtataaataaattttcacggagagttgtcatgaaaatgcagtaaatggtggtctgaatctgttggaaatactgctttgagactaggaggccctcagaggctgaaggctgttcactttaacgttcccagcgtatggtttagagatggccaccactaaggatttacccccggtggtgcctgtctaccatggtttaatgcttcatcatggagaacaggaagtcattcatcgttttgtgaagtgaattttaacataattactcatttatcttctattcagtgcaatttaacaaatacgattgggaacttacaatgtactaagcattgatgtagatgctatgtagtgaactaaacagaattcctgccttcgtgggaatttctcttcaccaaaatatatatatattcacttggagtttcacacgactgaattaaatggctgcattatgaaataacattttagaagaatttttgaggattgacctgagttatccctaagatcacaaatggaatcagaaaatttggagtttagcatgtgaaacctggattaaattagcaaaatgttaaccaagggactgtgtcttactaatgcagcaaatagtcaggagtggtttggagaaatattttctgaaggtgaaatgaataaaccagtgggtataggactttgccccaaaaaagtcaaccaaggacattgacagaattaaagtttgtcctttgactttaaaaataagtcttcagagctgggtatggtggtgcctgcttgtagtcccagctacttgggaagctgaggcaggaggattgcctgagcccaggaggttgagactgtagtgagctatcattgtgctaccacattccagcttggaatctaaaatttaaaaaaaagaaagaaaaaaagtccccagagagtcatttgatagaaatcttttttgactctttttttttttttttttttttttagctccatgtattttatttcatgtatatgcaaatacctttgggccctggagttaccagtattttatgtttgtttcatctgatcaatgaaaacattaattagctgaatgcatatgtttcaggattctgggatgctacttcacaaattactgcagatttctatactcaccttaaatgggttaatatagcttccacggtgtctatttctgtattgtagtttatgcactgagattttttgattcagttatacatatgaacattttaaatgtgccttttaaagaatttaaatactcatatctttttgcatgtcttttttcctttttacaaaaggaagctatggtcgttttttttttttgttttttttttttttttttaccatgactgcattcttggattccaaatgtatgctaaaaaattcgtgagactgcaaaggcaaccaatgaaagaaaaacacatttgatatggatttcaaaatatcaagagaatctggaaaggaaaccaagatcagcttttggttgcagctcatatggctgtttgtgagttaactagcttagaagggaagtaaatagtttatgagagagaaaaagatagatattctggaaatcattattaagctgaaatttctgcatctaattttggaatgtttatgtttagaaagtcacatgcacaatgaaaatgtgtgtttcaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctggtgcaaatgctgccattgtttaattgttgatgatgctgcataagaatccttaaggtagaagcaatcttgaccttttttatttttgcaggcccctgccagtgcccttctccagactatattcttaaaaattaaagtgctttggtttgtagagttgactgtatgtatctccaaaatgaatatgcagcagtgattttttttttcctccctgatctctttcctgctttggtaattctgtgagggtataatcatattggggctgtccttggcaggttaggtgacatacaagaacatgcggttccacagcagtcctgtcattctcgggtaagaacatcaaagtgagttgcagcacttctgcattcatacacgtaaatcttaatctggaaggaagatagaatctaccatagtgaatttctccagaagttttacgcttgagtgcacccagatctgtaggcgttgacccaatccagttgccctagggaaattctagacccaggagatcctaaccgggctgtaatttcccagatcacttctaacctgaagcagacgtaccaatgactccttaccttgcagagcctatgcttaggatgccaagtgaatttttcatttgaattgcttcagtgattataaaacatgaaacatagctttgcagatttctaaccctttttgtgaaaaaaaaaaagaaaaaaaaaaaaaaaaagtttggagtcctcaagttttatatgcgtcttagccctcagccccttccaaaaccagtgagaaagatgaaatcctttatagagaagattttctgttgcataaagcatgttatttgcttttcaaagtgtgtgtgtctatatatatatactttatatatatacatatatatgtatatatatgtgtctatatactttatatatatacacacacatatatgaaacaagggacatttttacactgacttttaaaatcttgttattaggattttttaaagaagttaaggctgatgctggccctggtgataaatacgtaaagagattggtgccttgtctcatgatgtgagtttctttcttgtgcctttttaggggaacttattcattctgttagagttgaggttgcaaactgtaggctttcatgctaaagccaacctacaggcttatgagttcagtctgacagtgatgaccctacttaaacaatttggacatgatgcataaaaaatacacatctgatttgcttggaaactgaaaatatttgagaacactaggcccctgttcctgcagagtgtcagctgctggagccaagcagcccctattgctttagtccaaagatgtcctctctagtttgtcacagtccacaccattccctttgcgtgacacacagcccagcctgctcatttatgatacctgccagacctccttgccatttgagtttctgctgaaattacaattatataaagccctttaaaacacctgtactatccatacacaaactaggttccattttctgtcagttcgtttattcacatatacatgcaatgaggtaccttatttagaggctgctattacacaagttctatgtgctagattcatgtgtcaccttcagatagttgcctcttaggcatatcataaaactcagtagatcatttagacctgttttccgaagagaaatggaaagatgccagaatctaaccatgttttctctccagaatatgaggcttttgataaactgccttgggaatgcaattaggttgcacaacctctgaaacaacatattcctcataacatataatataaatttttctaatgtagtataagacatttctaccctttttctgtatttttttgtggacaaaagaaaacaaaaaccattttgtttctttaaaaaatatttttctagtttgtattttgtacatgcctttgtaaagatatattttttaaagctcatttagtgatagaacccgagatgatttttatttttttatttttttttagtaagttgcagtagagtccttttgtaagctagagaggttacacatcttccaaagatatccaatgtataccatatcttcaaagaagaatctaacttgataaaaaaattttttaaaagataaaggaaattaggtttggagagagacaaggaataaggtggttctcaggataagtgtgactctgcatccctcaatcatattccctccttgccagagactctcctgggtgacagccatggagggaaagcattagtaagatgtttccaccataaatagactgatagtcactgtggaaagcaaaatagatctgttgaatgctgtccttttatttaccaaaccagggacaggttttctctttggcaggtctcagggccagtggtgaagttgtggggagaaagcagtaaatcccaggcttttagggaatgcaaactcgttgattatatggaaagatgggtcaaggatctgttactatcctgttgatagggaagagttcacagggaatttttagatgtggttaccttttggtgagattgtaggtgatttaaatgttcttctttaaaaaatgttctttgtaataattttcacattttgtacaacataactataataatttccacagtttatcttatatacctatatgactttcactgagatataattaacataccatcagattcatccaatttatttataatccagtgcctatttagcctattcacagggctgtacaatccttaccacaatttaggacacagcgtcacccccccagaaaaaagtcctgtacccattggcagtccctcccatttatcccaccctcagccctaggcaaccactaacctgctttctatctcaatagtttagcctgttcaggatgttttgtatgaatggaatcacacaacatgtggtcttctataacgggtttttatcatttaacatgttttcaagatcacgttgtaacatgtgttggtaatttattggtttttatggtttcataatattccattgtttggatataccacattttgtttatcgattaatggacattggcttctttctactttttggttgttattaatgatgttactctgaacatctgtgtaaagatttttatgtggacgtatattttcatttctcttaactgtatatctagaagcggaatcgctgggtcatatgataatgctgtgtttatcattttgagtaaaagtcacactttttaaagtggccacccttttttacattaccaccagcaatggatgagggttttaatttctccatatccttcccaacttttgttactgtatttcttttttattatagccatctgagtgggtgcgaagtggtgtcttattgtggtacctctgtgacttttgaatttaaaaataagtataaaatatttttaaagaggccgggcgcagtgggtcatgcctgtaatcccagcactttgggaggcccaggccggcggatcacgaggtcaggtgtttgagaccagcctggccagcatggtgaaaccccatctctactaaaaatacaaaaattagctgggcgtggtggcacctgcctgtaatcccagctactcgggaggccgaggcaggagaatcgcctgaacccaggaggcggaggttgcagtgagccgagatcatgccactgcactccagtctgggcgacagagcaagactccatttccaaaaaaaaccatatatatatttttaaagaaccaatgaaatgaaggaaaaggaaatcggtaagtgagccttttttatgaaattgaaagcacatgtctgcagttaaactgagaaaaaagtttggagcccatctaaccccttgacaatttcatttcaggtggcttctatgcagtttattaatattgtagtccattcagtagaagatatgaatttcagagttcacctgcagtatgaatttaccaaattaggcctggacgaatacttggacgtgagtatagctgtgacctttggctccaatataagaattgacttattattgcctgccctcaaaggtacgcttccatagcagctaaagaatgcctaaagctctatgcagtcaactactgtagtgctagttaaagggaactgagctgagtgatgtactctgccagagatgctggattcttgcagggctcctgggatctcaggtcatcttctgctagcagccttttagtacgggagtcagataacctcttgcagccttgctgcagctttcctctccttttgagcttcatctgggtcaagtctcattgcatccttcatctgggctattgggcaatttgtgttcttggttactccggggaccccatctgggcagagaaagtcaagccaagactgtagagtgatgagtcagtgcttagagcataaaaaaaaaataatgaggaaatggacaccagagacttcctcctgaagctgctaaattctgcttcaagtgtttgtggctttagaagttccacttttagttcttaggagaaggaggtttaaagtttccctttttctcactcccttgcagaagagtttagccagttccctgaagttcttcagttaagaaacagaaacttgtgaaaatcagaaatggtcttgaaaaggctgatggctcacacctgtaattccagcactttgggaggctgaggtggaggatcacttgagcctaggagttcaagaccaggctaggcaacatagtgagaccccatctatacaaaacaccaaaaaattagccaggtgtggtggtatgtgcccgtggccccagctgcttgggaagctgaagtggggggatcattggagtccaggatttctaggctgcaacaagctgtgattgcaccactgcactccagcttgggtggcagagcgagaccctgtgtctaaaacggaaaagaagtggacctgaggatccaggcagttttgttttcccttttgtataggaatggtctagtgatagagcaagaattgttgacctcaatttccttccttttttttgagacagggtttcactttgtcaaccaggctggagtgcagtggtgcaatcttggctcactgcaacctctgcttcctgggttcaagcgattctcatgcctcagcctcctgaatagctgggattacaggcactatgcctggctaatttttgtatttttagtagagactgggtttcaccatgttggctaggctagtctcatactcctgcctcaagtaatgcacccagccggtgacctgaatttcaagcctgtttccagctgtgaagaatatagaagtacttcctttgggcatctcaggaattcagttgcccatctttgttagagataaacccaagggattgcacagactgtaccctcagtttattaggagacggaatcacagaggtggttactctcaacctgaaggccttgcttcctagactggctgggctgcccttgaatagatgggcctactgttgtctaaagactactcagggagaggcgtaatagatttccattaaaatgttgtttgaattgctttcctttttatttaaaggctcatttatatcactggcagaatattgtacagaaagactctttcttactttgagatcaaggtttgtctatccctttttctcctatgctctaaaagtatcagtatttgaacaaaaattggatgtataaattcctagcggtgttttgggtttggttttgtggtgtctgagcagagcttgtttatgctgtagaatataacggcaggtacccacttatcactgaacacctgttattcattgtgaatctcatgaaaaatcccattaagctgcttctccttttgttctagcctttgcccttatttagaagccattctcacttgtgactcataaatgaaaacagaacactctctcttcagaataagctgtattgtagaattccagattaaacctaggggaaaatccatttttctgaaaatttatgtagagtggaatttctcttaaaaatgtaagattttttgtcaaaactctgtatttctttaacttcatcatgtgttgactctggaacctaatagaggtggttagaagagtaatgtaaatgtatgctatataaatgcttcactagtttacaaaaacccagccttgtaagtagccattgatttgttcaataaatgttgattggcatcatccatgcaccaggtattattctaatcactcatctgttccccagggaaagtcatgacttatgttacttgtagggaagattcactgatttatttgacctctaatttccagagctagctgagtccctgcaggatgcctagtttgggaggcagtgaattggggaaagctttctgatctgccttggggagccctgagctgttcatgctgtatactgacttagggagggatgtgtggaggttgggctctagcaatttgtgctaaaataatccccaaggctaagtataaactctgtcagtgtctgccccacctctcgcctaaccttcttcccctactggaaccactgtaactaaccaggtaagataccaaacactccagtcttttccactacacagatacccctcaggttttatgtggccatgactataacctgttaaagctgcttttaatttttctgttgtcccaatttcatgtatatcaaaatgttttacataggaatataactacatggggcagtaaggatttgggggaaaatgtgtgtgcatttgggagagcgtattcacccgaaagtcatctgatgatactgcttaggcagtcactccataattctcttaaggaagatgacatgttaagctctcttggaaagggctggactatttgtcgaaaagaaaacacatagactggctgggtgtggtggctcacgcctgtaatcccagcactttgggaggctgagccgggtggatcacgaggtcaggagatcgagaccatcctggccaacagggtgaaaccccgtctctactaaaaatacaaaaattagctgggtgtggtggcgcgtgcctgtaatcccagctacttgggaggctgagacacgagaatcgcttgaacccaggaggtgaaggttgcagtgagctgaaatcataccattccactccagcctgggtgacagagtgaaactccatctcaaaacaaaacaaaacaaaacaaaaaacaaaaaagacagactcttaggaaatgatgttctatttccatagatgagctaacaccacgttctctcctattctggtttttagaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatgtaactatatctcagaaaaggaaaaattgcttacatttcagctggttgcaaagcagaattaatgtcagcttttatggtggtaaatttaaggatttggagtataggaataggccataccctgcaagagagagctatcagaagctgttctgtgttttttccaaaaagcagatgtgttatgtaaaatgaaatagaatctgttgctttgctttagctcacttacctgctcagtttctgctgaggtgcatttcctggcagtcttgcttacaggctcaagcagagtgggggtgtttgatgattggcattacgtaaatgattagagggaaattaaatatgagaatttggcctgaggcgaagaggtatcttcttatcaactatgtccacacaaacccatggacaggattagctggtgtctctgtgatgcatgtctgaacattcctgtcttacggtactcaaattcttaatagagtcatttcaacaataggcattttcaaggacatcggtgtgctttctcatatatcctgttctttgaagaatgtcctcagtatcgttgtcagctctatcacaggacagggtctcatttttctttgagggatttttcttgccatagactgatttgaatatgactctaagggcctttagagattatttgttcattcattaaccacatatttcagtagtaaaagaattaacagaaaaatggtgcttctcaaaaacccaagcattatgaagaccaaattcttttggtgagtctggtgagcactttccttgattatgaaatgaagtgtctccttttggaggattattattttctcctttgaacagttcatttatttttctccacatgttttttaaagagtgctgcatatgctcagtttccttcacctttccccatcactgtgaaaatgggtctcttcatggctgtgggtaagccaagttggtgagccaaaaaccctccctttaaaagtgccgctatgacccagctggcatccgcttaaaaagagaattttacaggcccagtatatcttcccttagaagatttgtgttatatgctgaacccaatcagtgtaaatctccactcttcctccttaccttgcctccctggttttctttacttgtaatgaatttaaaggagatgttagaaatcagaagttgctcagtgttagagccctatgtgaaaagcagctgtttaacacatggctcaccctgtctttctcctgaagcctcagccaacattgcatgaccatacttacatgtccacttttgtagcagcaatctatttgaatggcctcccccaaataacttttattattattattatttttgtgggttttttttttttttttttttggagatagagtcttactctgtcacccaggctggagtgcagtggcgcgatcttggttcactgcaacctctgcctcctgggttcaagtgattctcctgcctcagcctccctggtagctgggattacaggtgtactccaccacacctggctaatttttgtattttttagtagagatggggtttcaccatgttggccaggctggtctcaaactcctgacctcaggtgatccgcccaccttggcctcccaaagtgctgggattacaggcgtggcaaccaacttttattacttgcatagtttggtcaaaccaagcagtagttgtttttcaactggctacctagattgaaagaaccaagtttactgtgttaccaattttcaaaagctttaggctgatggccctttcttggcatggagtgggggatggaggtggactttccctcctctttctccttactttcctctacccttgctagcccctgcagaaatggagggaggcacactgtgtatgttgaacactaaggagcagacatgtgggtcttattaagaatcatgtctaagttatcaattcctggtagaagcaaatatgtattcagaaccatattataaacattaccatttccagaaaacaacttgcggaacacatgcagggccctggtccctaataatcttggagctgcactttctgagaactgagggctgatcaagatgatcctgtattgtgacagctttcttttcaaaattttacagttatctgaaaaactgcaagacacagagaatgaagccatgtccaagattgtggaactggaaaagcaactcatgcagaggaacaaggagctggatgtcgttcgggtaagtgtaatgatgacaactgcccagatgggcacggtagggaatgtactccagctttcgtccagtggaacgcagagtaccttcatttcagaggaatgcattgatgcagcatatttattggaaacctttgagaggtgatgctcagttgaaaactacacatagtcggcgttatgtatacacatgtgtgtgcaatcagatactgggggttcagtatttccttatcacagattttgggagcaacagtgttttcccatctggaggaggctgagttaattctgtggaacacccatttggttggaaataaaaacacagcatggatttaattcatgccacttatttatttttattaggacttgagcttctttgtatttttttgctttgcttccactcaaaaccagatttggtggttgctgtgtaaacagtgaaatacaacacaggctaggcttaatggcattcaccaaaaaaagggaggggatgtgcaaagcaaacccaatccattttattatcagctaatcccagctattttatttggccttagtattgtttaccttatgtgccaggtatttatggagtgccatccctgtgcttggaattgtgctgaacataagaacaccaaaatgcctggagagctttaaggcaaatggcttgcctttacaccactgctaatgaaattgcaccttttatgtgatggttatcgtgtctgtgtgtgtctgatatcctgacatgtcctacagttcagtccaggaaatatattttctggcacgccttcgagacagagttgtagcatatggactcaattcaacttcagactcttagattattagtaatagacagggtgtgaagaatgtttccctgcttgctggaggtttgtggtgagagatcgcttgtacaaggcccagcaaggaagttcagttccataaaaccctttcactagaacctctatgggccccccccttataaaaggaaccaggacagtctttgaattgaaaattgtaacttctttgttttctgctaaaaagctagacagaaataagtaattagtgaagggaagctttggcctgttttgttaaccgcattaccgatgggaaaatgttacaacaatcgctatcctgagcttggtcaagggggcgttgtgagggccagagaaagccattcagaaacagtcagcccctggttactcatgagtagattattccatgctttgcagatttttaatcccagtctgatttgtatccaagtctgatttagggcccttttgtctattgttagctgatatgtgtatctaagagttacaaatgaatgttaaaataaaaggaaggaaaacatgcaccaccagaacaccctcaggagattccagagtcagcattccgggtcatttctgctctgtttctttccacctgcagggaaaattgagttagctgcatttattaaatggaaagaacttcattaccaacaacaatagctagaatatattacatgcattactagcatacaactaataattaatgggactttataggttctagctgaattccaaagaattcccattcatatgagtatctttttttctctttatcctcagtttgccaatctgatgctactaagtatgaatgttatgtgaagataaactcttgaccttggactttattgcaggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacaggtaagaagccttggcaggaggactgaggaagttttggaatatttgtatttcttcttttgccaactgtccacttctgtcctttgtccgtttttgttggcatgttctttaagaattggttttcttgagtagttcttaactgtttacattttgagattaaatttataaatcctcatttcacatatgttgaaatatttttcccacatgtcaatgaggacattttttggtttttgaaaacagtcctttgtccttttaagtgtgttgttttcagatggctttatatgcacatggcttattgcaggaaagccattcccgtattttcaaagtccatctgtttcttttttctttgctagtgcaaaatggtccagtaacaccacctatgccaccgccgccgccgccccctcctccacctcctcctcccccaccgccccctccgcctcctcctctcccaggccctgcagctgagactgtaccagctcctcccttagcacctccccttccctctgcacctccgctgcctggaacatcttcacccacagtggttttcaactcaggattagcaggtaagagcacagaattcaaacccaggtactcatatcagaaatgctgtcttatctcggagagttgaagctattctttcaaagtccaggtctcttgcaatgatgtgtatctcttcctagtataagaaattcctgctgatgtagccgatagagggaacatcatcacgcatgggaggcactttgctctgagtagtctttgtcacaaccacaccccacaatgggaggttctgatctcctacaccatcttcctgccttccactggccccaccgagagaatggaagagagacaagctacctgcttgaggatcagtgcatttttgtgggttcagcagatactttctggacacctgtagtattcaaagctcagtattaggcacagacattgagtgcttctggatctttttttttttaaatggtatttttgatgtcatctataaaagggaaacatgcttttatgtgtaattgcctgacgtaggcttccaggcatgtcttctgagcattcgagaacatcagaatttgctagagtggatttaaacttcaaggaggaagtgctgccaacagccgtattatcatgccttaaaatgctgccaaataattcatgtcctcttgccaaccagaagatagaaaacagcatcctcacctcaccagaaataaaatgggaggtaggggttagagcaggaggaagagtcactctaatgccttgaaatctaagctctttgttttgactcacggaaacaaagatgacgctacgagccgttttctcagtcctgaagtgtttccctggcatctggaattgctctaagctttgccatccctgtgacgtggggtaattctgcctcctcatttacttcagcctgttcatgaggtctcttatttacaataaagaactaccactctaatagcctccatttccaaggctgtgatagttctcagagccttttgcccaaagtctaaaagccagtcttagctgtaaagatttcccaatctccatcccttccaggatcccatctgcagctctgccagccggtcactggggctcattcatcccaatgactggagcccttttggatgccccagagtcacctagaataaattcactccacatcaaatccatggttttacttccaccccgacttctatataaaactgtcagggaaacaagattccagttcacagtaaggtccacagtaaatcggtgacttatttctacccttcaagatcttccccgtctaccactttcttctagaacttttattacttctgaaggagaaaagttggagcagagtcatcgtggaactgatggactatggaatataaacagacaaacaagaaacctcatatcaagccccgggaatgtgttccatcaccaggctgttgtcagtaactgggtgtggaaacccattatcgtcccgtgcacctggccaccctgattaggcactcttggtagcccccaaggcgcacttgctgtgagatgtgtctgctgtggtatctcatttggggctgcttcctttgtctctgacaaacgctgatgtgtgatttagcacccacttccacgcacctgagcactaacatagacctcagaaccgccttagccgagtgagagcccagaggctgagatgtgtctagagcttccttccaaggggccatgtcctgtgtgattgatctatttattaattgttttgcttgggttcttcccactacttgattttaaaaatgtgttggctctgtcaattgcctcaatattttaaggtgtagagctctgtgcttggctgataaccaactgcttttagggtttgctatacttggaagtggtccctgttgtggctcatgcaatttagaggactgtaggtgggaatacaggaactctttatttccataagtgtccactaaatgattgtgagggatgtcttggaagcattataagatccttgtgagtctttgatagctcgagatcaggcaatttctccaaggcctttaatctttctttattattcatccttatttagactgttaattcttagtgattgaagcccatttggtgagatgttttgctagtgtgttgagtaactctctctctcactctggaaccaagaggccagacagaatcaggatgcccagtagaatgaagagacagagctgagctaatattctgaagcctcctgggaagtcagaaacctatgacatcacttggcctctggacccacaggcaacacgagggtcttatctcttcaatgggcaggtgtgttcttggagaccaagacagaagaccaagaggagagccccatagtttatctagttgagagttttctttgtattttatagagaaaatagtagtagtgtgaaatatgcatttgaagaagaaggcttccttcctctcaagtctgtgatagaacaacctggctccctttcccccggtaggtcacctgagacaggctgctgagcaggtggaacctttgccgtctgtctgggaggatgtgctcggatcctcacaatgcgaatttggactttggttgattgtttttcatgtaaaaattattcctatcctatggaatgcctagcacagttcagtattgctgtttggtaccactacgatgaaataatttttttcttccctcttctaaaaaggataattttaaaaatgaaatagttgagtcttggaggcaggcctgaatggaaatgaatttttggctctgtgccgccttgtgaaatgtgtccaagaagcatgaaattctatgctgagtgcgtgaactgctgagccacttgactctaaccatatctaattttttttgtattttctctgttctttctgcttccacaaaagatgggccaatcaagcttttctgtaggttgctcctcactgagtgtgttgagtatttgccatgtgtttctgttggtcacactgtgccttgacatctttccactccattttgctttgatccattgcattttgactttgtgtctgcgggaagtcttggtggtggctgatgatgattccaggtttgcccacacattctagttgaacctacataagagactattgtccttgaagcagacatcctggattcatatgccctcttccatttcctctgagaaaaggtttttttttttttttcttcttcttcttttaatttttatatttgtatctgagacttcaactctaagaacaaaaaaaaggtgccaggtgccccttttccattccctccctcatgctggtctctggcccactccagggagcactcacccgcctttagcccgagccatggggacacagtgtgtccagtggtcacctatgtgctttcctcctcttcccactcccaccctggttaaagccaggaaaacctttccaaggaggagaactttcttgcctgtgttctgatctcaggcttattcctgaccttgctaaatagttagaagggtggttgcaaatggcaaacttctagcgagcgtcatgagcctaccatgtctgtgggaggaaggtaggacgccattggcaccaacctgtcacctcaggttatgaaaagactcctctgcggcccttctgctgctccccagatccctaacattgccgaagtgccagaggcaatgctagggcaagtgctagaggaaagtctgttcctttgtcccatcgagaacatctgttttcctgggtagcgtagacaaaatgctgtacggtgaggaatctgacactgtggcgtagtggggacaaaggtgtcatgtttggtggtggagaggcctggtttggctaaagctgtgtctgtttttctgcatgcttttgtgtggatttatcagatgacattcctgctgtttaaatggcctttgtaactctggaggaatgagaggcactgtctgtctcagttaacgccaactgaggcaggcaggcaggcagccagctacaagcttagtcgtgtgttgcttttattttgttctgcactgaagcgctgaagttctcctccctgtcttgctaataatgacaaatagtgaagctcccaagtagtgtggtaggctacccagaacagactgacgaagctgaatgtgtatggctaaatggtttgggaagacttctttatgatatataatagataaatataattttaaatggattaccttttttggcatattcccgcacagtgagaggagttggcactccccatagtcccttaaagatacatcccattctctctattaagaggttttcagtatttttaatgagtgtgtagatacctcctagtcaaacacagctgactcctgggaagaacttgcttttcaaaatgaagggcaagggactgtggctatttctgagtctgagaatccatacaattccttcccttccctcccctcccctcccctcccctcccctccactcaattcccttcgcctcccctcccctcccttcccttcccttccttcccatctcaaaaaagaggagtttcctcccttcctcccttccttcctcttttttgagatggagtttcgctcttgttacccaggctagagtgctatggcgtgatctcggtgcactgcaacctctgcctcccgggttcaagcgattctcctgcctcagccttccgagtagctaggattataggtgcacaccaccacaactggctaatttgtgtatttttagtagagacagggtttcaccatgttggccaggctggtcttgaacttctgacctcaggtgatccacctgccttggcctcccaaagtgctaggactttgagccaccacgcccagcaatttcttttccttcccccccgccccttttatttatttatttttaagacagagtcttggtctgtatgtaccccttttttcactctgttgtcttaaacattttcttaggctgggcaagatggctcacgcctgtaatcccagcactctgggaggccgagtggggaagctcgcttgagttcaggagtttgagaccagcctgggcaacatgtgaaactctgtctctacaataaatataaaaattagccaggcatggtggcacacagctgtggttccagctacttggaggctgaggtgggaggattgcccgagcctgggaggtcaaggctgcagcgagccatgattgcggcactgcactgcagcccgggtgacagagcaagacctcaaaacctattttctcatttaggccattcatatcccttagtctgcttgaaataacccagcagccaatatatcttcattatcggaatcacccacaggaagtcagccttcatgacgttgtacttctggtagtctagtcagccactgtctgcagtccctgatcatcttctaaggtttgtttgtaaacatgtggtctgcaaccaagaatttaggatgtccaaatatggcaagtttttgccctctctgctatctagtaacatgagtaataatctttgctctccaacactttttatttgtcccaaccattgtcctaatattgtaactgtaatgcagcaaattagttgcctgagttaaaagaaaaaaaaaaatcaacccttggcccttaagacgtcttttaatacaatgatgtgttagtcaaccaaatgatgacctcaaatggctctggccaaggccatgtgtgttgttttccagctttaaaaacctacttgcgcgcctcttgccaaccttcctccagtgtcaaagtgtcatctgcaaggactgttgtctgattgttcctgagggtcgtaggcttttggtgggatcttaattccattctctttgatgtctttagctgtgaaaattaagaagccaatcaagacgaagttcagaatgccagtgtttaactgggttgctctgaagcccaatcagatcaatggcacagtcttcaatgaaattgatgatgagcgaattctggaggtatttttctcattggttagaaactagaggtgcactctgtgcagcaaagccggcatgggtgttctgttaacctggaagtgtcagagataaagtactagtgttttaagtcccctgatgtaaagaagaaacatgtatgtaatattggagaataacatttgacactgttttgtaaggtggctctaaaactgttcaaagagttatgttaaattggaataaatgcttttgagcatctttagtgtatgccacagaatatagatctgacataataattccttcccttaattgagagaaagacataaaaacttttggactgcaagtgagctcaattatcacactcactgccttatctgatggataattttaatctgtggcagctgtctgtgcaagctaattattgaaaagtaattgaattagtgggttagaatcggtagtctaatgttcacttatttttttattttattttatttttaaattattattattattattttttgagacggagtctcactctgtcgcccaggctggaatgcagtggcgcaacctcggctcactgcaacctcttcctcctaggttcaagcaattctctggcttagcctcccaagtagctgagattacaggcacacactaccatgtctggctattctttgtgtttttagtagagagcgcatttcatcatgttggccaggctggtctcaaactcctgaccttaagtgatccacccgccttggcctcccaaagtgctgggattacaggcataagccaccacatccgacctatgttcacttttgtgtatgtgccagaagttgtactataacaaaaacaagaaaaatagaggaagccatggccaaagacaagtacttaatagaaaaagtgacgtttttgcttaagaaactaactggtggcttccggacttcatttttaaatataatccaattttccatggtcattcctctctatcttaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtgtaagttcaggaaaattatattctagttagtttatgataaaatgaaaatgagaaagttatgaattagtagatgacaaatatttcaatagtgagacaagacctaagataaaagctggagcaatttttgatatccacacttgagagatctgaactctgtgtgtgctacttcaaagttgaatatgatgccaacacgaaagaggtagaccagaaatcaccctggggagtgttgtattagaaccagtaactaattgttttagaagaataacatctggattgtgacatcatttattatctgggtctactctcttatgcgggcctccagcaatgcttacataaaaggaaagttgagctgagcgtggcagatgttaagaaaaggtagaaaatgtcagttttctctggagtatctggattttatccagatttgttgaatacaaatttgatggcatttgtggaatgatacagttcaatgccagatgcaaatatgatacagatgcatattttaattcgtaacaacaggaatgtgaattgttttgctttcagtactttcaggacattttaaacaaagttcattttttactcttgaactgcatagaaggcattggttttactcctctattagaagaatccttctattcttcttgtggccatggtgactttcaaatgtgatgaagacattattaaatgttttaggaactaattatttataaattgattatcttatacattttggttagaggcttcgaggtgtaaatgaccctaagaaatcctttgttccaattttgtgtcctcaaccagggtcataatctggtagtccagtgcctcctacagtctgttctgatttctgtcattgaatcctgaagtgcagcctggctttaaatctttatatatcttgtttgtcatgatgattaaatgtaattctattatttagctgaacaaagattgtccagagaataatagagaatagagactgtaacaaatacttcatttgttcaaattaagcatatatccaaaaagaacttcaaggaatgtatgcacttaacctaaaacattcaataatacaggcatttggatgcatttttttccaaagaagaaaaaatactaccagactattggtttaattgaaatattttacataattcaccagatattctgtactaatgtgtacagtgttaatctcctgaattagctgtacttcacaatgcctgtcaactatgtgcttgaaccatgaaaccatcagatgctttggccttggttctacctcttcctattttcatttactcctgattccagaggcttagagctatgccagtaccctaaaaactgaggatggcagttgtgacaaggtccacgttttcaggaagaaccagttaagttacctgaggcatagtcaagaaccagcaccagggtgggacttcacaggacagctggagaaatcttagactcgttgatttggtgtttgatgagctgtaccagatggatgatggatggatgaacctgaaaagatggatgaacttgaaaagggggtaggaggtttttctctctaatgctaatctctccacatctgtctttagatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctgtgagtggactgactctggcaggggagggggtccaaagaaatgtggaatcgttattttttaaagtctctcccagaatcgtactcagtgtgatgggttctaaagactccttcccagaactttctaaattgcatttttatttcaaccatcttttccacattatgtatgcaaagtaaatttgaaaaatggggaatgttcatattccatattgccattcttccgaaagaatgccattttttgtgtctacagatgttctctagatttcaaaaggacaggggacaaagaaacttggttcttttctcaaacttggttcctctctgaagatactagtcttctggcagtgttggcaagactgaaaataagactttcatttctaaaaatgttgcctcatctttagtgagcagacttacaagcttttgctgaaagctttatatttaccataagagttttctttcttggaagtttgttataataaactgtggtgatatagacataatagccaaccatctctcattcccttgtgttaatctggtggagatttatgaatatcataaacttcagttctctcccaattctgtttctaaatagactttgttactgattatagtagtcagttctttcccaattctgtttctagataaatttgttggtttctgcttatagtagtatgtctgttgaaaacatgttctgagaacttctggagggtgttatattcccctcccttttttttcatttttgatgcctccttcattgatttaaaaatattaattgtatgacatgattagaggtggtaggcaggaaattgagttctaccagaagcagctgtggactcttaactctgagtcttagtggttgtagattggttacagattttgtgataagcaagttcctatgttacttgctattgtgaacagtttcagtaaagatcgtgcatgtaacaatattacctgagacctagcaagacaattaaatttgttatacttagaaaaagtagactctcaccatgaagcctgtatgctctaaatgcaggcctgttttcttctgtcttaatatttacttgccaattagtttcccatttttaacatgtcttttttcccctttttctttctttgattggaatctagcaactacatgcgattatagcagcatctgtctctataaagtcgtcccaaaaactcaagaaaattctggaggcaagtgcagtttttcttgtaggtatgaaggactacttcagctgcgttcagtgcctgatgtgctgtactgatgggcttctgttttcaccttcttttgcagatcatcttagcccttggaaactacatgaatagcagtaaaagaggagcagtttatggatttaaacttcagagtttagatctggtgagtggactaaaagaaatttgagagctgtttgaaggacagatggctggcagagatgaagttagggtggtggaggatgttttgatgaatattttctgctatgggaggatcaactggtactaattttctggaacaccatttgacagagagcacatagaacctataattactcataccctttgactcagtatttccatttctaggaattttttctcaagtgtctgaattttgaatcctgtattttatttataattgcaaattaacaatctaaaggtctaactgtgggaatgattaaatgtgctgtaacactagttaatacagtgaactattattcttccaccgttagcatactgatgaagagtgtcccaagaaagatttgtgtttagaaaagaaagcagggtatgctttgcatgtacagttgaatctcagctaagtaaactatgtggggagaaagactgaatggaaataggttaaaatattagcagaggttggatggaatcaggaaattttttcaaactgctttttgtaagtacttttctatattttcttaaatttttgttgttgttgttgcatgcagggtgctctaattttcagagtcacctaactaatgtgaataagactagagaaaatcctccgtggactccctccagactgtgcaggcctaacgtgattgtcacatgagaaggctgggcagtgggttgagtcccccgaccagggagctagttatttaatatggagtgtctagtcagtcacagttctggcctccagcagatcatgatcagttaagcatgtctgtttcaggtcttcacaggctaggaaataagggagggcctaagctaaatgtaaaaactggagcataggagccctgctgtgtaggaggcacctgcatgcacctgctggctgtacatccccatttctcctctggctttttactttgaagagcactaaaattagagccgtcctgcttttaaggcaaggaaggtgggatagcagatgcagggctgggagagttcatgtaatcagtgtcccccttatccatgggggctgtgatccaagacccccagtggatgcctgaaacctcagatagtactgaatcctatatatacactgttttttttctagagatgcatatctgttataaagttgaatttataaattaggcacagtgagagattcacaataactaaaaaataaaataggccaggcctggtggctcacacctgtaatcccagcactttgggaggctgaggcgggaggatcacctgaggtcaggagtttgagagcagcctggccaacatggcgaaaccctgtctctactaaaaataggaaaattagctgggctaatttttgggtcacaggcacctgtaatcccagctactcgggaggctgaggcaggagaatcgcttgaacgcaggaggtggagtttgtagtgagccaagattgtgccactgcactccaccctgggcgacagaacgagactccatctcaaaaaaaaaaaaaaaaaaaaaaatagagcagttaaataaaacacgttacttgaacacaaacactgcaataggcggcagttaacctgataacccagatggctactaagtgattaatggcaggtaatgattacagcgtggatccacttgacaaaggggtgattctcggtctagggtggatgggaatggcacgtgcgaggttttatcatgctgctcagagtggtgcgcaattcaaatctgatgaattgtttatttctggaattttccacttagtatttttggatacctgaaacctgtgggtttcctgaaaccatgggaagtaaacctgtgggtaaataggaactactgtagaggaaagctgcgaatcattcttaggtgcttagagtcatccctatagttaagcatgtgccctggttggaaagtccttgagccagttaagcatcaatggactggttcactaaggaacaaatggaatcctgaccctcctctgggaatgctccagcctgttgggcgactgttactcagttaatgactctgggtgggaaatcgtcacctgaggggtaagtgtcttgttaccctttactcttgtacctaacccacgttcccttttgttttcagctcttagatacaaagtcaacagacagaaagcaaacactgttgcactatatatccaatgtggtgaaagaaaaatatcaccaagtgtccctgttttataatgagcttcattatgtggaaaaagctgctgcaggtacttgatttcagctattaccgttcgtcttgggtatttaatgcctttaattgtggtggagccattccctgcttaaacacttttcagaacccatttaaaaagccaaggctaagaagtcagacacactgagctggaacacatcggccgtggtgttgtccacccctgagagcagaagagcacatgggtgtaaaggtgatctctgtgtcctttctgtaagacacaggccactgagcgtcatgtcccttccctcttttattcactgccctttttattctgctgctattgtatgaaatgtgagaatgagaatctgagaatcatcacccaacaaacacttttaatttgattttgtgccattctacttgctcaagtgtggcagttgtaaacattttgcctttgcctggacactagttaaattattagcacttcttggttgctactttgctaagacagttatacattttgtcatttaaatcatctgtgactctaagatagctgggatgtacaaggtaatagtatctccattattataggtgagaaaattgagatttttcgaggttaaatgtcttgcccaaagtcacatgagtagaaagtgatagaaacaggactagaaacctggtcttacttctcatgaagtgtattatccaatgtaccatgttccctcaaaagcatattcgattagcaaaaggaatgatatgcagattgaccttacagtcatttataggctgtgattctcaaattgtgatatcgaaccataagcagccagtgtttattataaattcagattcctgtggggtacctcaggcatctggaattttggagggtgaggccttctctaactcagccatggtaaatggctgctgcttctgtgttctcactaaagaacactctggtctaccctctcgtacaagatttctcatactgtattacaacaatttgcatgtccattgcaatctgtgctcttctttttttttttttttagacagggtcttgctctgtggcccatgctacagtgcagtgacatgatcacagctcactgcagtcctgacctcccaggctgaaacgatcctcccacctcagcctcctgaggagctgggaccacaggcacacaccactatgcccagctaatttttaaaatttttgtagagatggggtctccctgtgttgcctaggctggtcttgaattcctgggctcaagtgatcctctcgcctcagcctcctaaagtgctgggagtacaggtgtgagttaccatgcctggccaatctgtgcacttcttaagggtatatcaggttttatttatctttctatttctctcagcccctgaaaattggatgttggaaataaatgaatgaacaagtgaacaaatgaatgaatgagatgatgcactgttacagggacaaatgctgcagaagctgtggtggagactgagaggcagatggagatgactctctgactatgaagaactatatgacgcaggctggatagacctagagcaagttcggggctcacttagacagtaggcagaatttctgttctgaccaaatgattttcctccttttaagtttccctttgcctaaattaattacacctcacaattctaattaagaaaaatgttaaaaagctattataatttctacctgaccaatgggtactaattcattttgtttggtccaaatggtgtcatttgaaaaacatcggtggggaaaatgggagactgggttgctccctggcagaactgttctttctgtttgctctctggtgcccaggttgcccaacacagattctgtattccttcactcatgtgttcactcactccttcatttatccagtgaacacctttgagtgccctccatgtacttggcactatcataagtattagagaatcaaggatgataagacagtgtgagtctactgagggaaaaacctactgcactgttttagtaggttggtgcaaaagcaactgtgattttggaccgtgaattatcaatcattataactaggctcaaacatctttattatggccgggtgcggtagctcatgtaatcctagcactttgggaggctgaggcgggcggatcacttgaggtcaggagtttgagaccagcgtggccaacatagcgaaaccctgtctctactaaaaatacaaaaattagctgggcatggtggcacatgcctgtactcccagctacttgggaggctgaggcaggagaattgcttgaacccgggaggcagaggttgcagtgagctgagactgtaccacttcactccagcctgggtgaaaagagcgagactccgtctcaaaaacaaacaaacaaaatacatctttagtaatcaaaacaggaaccattaagatcaacacatttttgccaatgagaaataagtttgtttattcctgtagtgaaaaaaatctgtgcttctagattcaacaactcttggaaagcattttccgcatcctgctggttgtggaagcattttccctgcaaaaagttgtcgagatgcttgaaaaagtggtagtcggttggcaagaggtcaggtgaatatggcggatgaggcaaagcttcatagcccaatttgttcaacttttcaagcgttggttgtgcaatgtgcagttgggtgttgtcgtggagaactggaccctttctcttgaccaatgctagctacaggcgttgctgtttggggtgcatctcattgatttgctgagcatacttctcagatgtaatggtttcgctggaattcagaaagctgtagtggatcagaccagcagcagaccaccaaatggtgaccatgacttcttttttttttgatgcaagtttggctttgggaagtgctttggagctgcttcttggtccaaccactgagctggtcattgctgattctcatataaaatccattttttgttgcatgtcataatctgattgagaaatggttcgttgtgtagaagaggagaagatgacacttgaaagcaacgattttttaaaaagttttctctcagcttataaggcacccacttaccaagctttttcacctttcaaatttgctttaaaagactgtagaatggttgatgttgagttcttcagcagcttcttgtgtggttccaagaggatcagcttcgatgattgctctcagttggccattgtcaacttctgatggccggccactaagctcttcatcttcaaggctctcgtgtcctttgcaaaacttcctgaaccaccaaatgcattgccaaatgcattgttgatgttgcgagttgtcttcactgctttacaacccgttttgaactcaaataagaaaattgcttgaatttgctttttgtctaacgtcatttccgtagtctaaaataaatacaaacagcaagttaatacgtcattagcaaaaaaagtgagaagtgtgcattaaaatgatgtataacataaccacattgatttaagaatgtattccaatatcaaacagcagatttcagcaaatactgcagttacttttgcaccaataatttgtccacgtgcagagttgagtcaggcaagggggcccagagctggtactcaacgtcctaaagaagctgctcaggaggctgtgggggagtgcctgccccgggaggggccacactgcagacagaaaggttcacactaaaccttgctgaatagggaggggttgttagctgtgcaaggctgctttgggtcctagtaatcaatacaacctatggtcaaccgacaaaaggctgccccctgctggagagtcagagaaatgcaaaaagagttgtaatcccaacactttggaaagtcggggcaggagtttgaaggtgcagtgagctatgatggaaccactgcactccagcctggatgacattgtgaaaccttgtctctaaaacacacaaaaccttaggcttgctgcagataaggacctctgagcctacgggcccacccataggctattcttgtaagagaaatggaatagttttgtgcaagtgtgggatttagagtccacatttgttacctgaactcctctgccacctactagcagtgtgaccaagggcaggccacagaacctctttatgctgcttttgctcattgacaaaatgagctaatgatgcaaatgaactagtgcatgcaaagaatgtaatgtagtgcttataatgcttctttgcattaaaagatctctgtgccaaaagctggaagctaggtttagggcccttgagtaagcctaagaatctcctgagaacttggcccagcagccagattcgctgtggttgtgacttccccattgagtttcactgggatgttctttctctgctttagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggcaagtattggtgcccctgaaacctgtgaagaggctgcatccattaaagctgcctgtggtgcaggccctgtatttggggagaaatgttccatttccctctgtttgtggagggtagctttcttgttgtaactattatttattacggggggaccattcccagggttattcttggaagggccccgtcctcattgtccttttctaatctggggctctttaccctgtcccctccccctcccctttcacttcaatactcactccagtgtgggtgctgtattcagttcagcccacatgcgtcaggcctgtgctcggcaaagcagtgtttcctgtgtagtgggtttctgtagatcttgtccttgaaaatcttacactatactgggggttgctgatagataggcaggcctgcaaaacagaatgaacagtacgctatcagaagaggcagaggcaaagttgggggatggggactcagaaagcagattcagtggaagggcctctggtttggggcaatcttgtatcatggaagagttcaggcagagactgagtgtcccctgtgtgaggctgtcatagggagtgttgaagcaaggaagtggaatttagggtcagagtgaccaagatcccttttgaccttgttggttttaaggggttctgccacggcctttggaaactcctgtaagaaagatttccttgttttgtatgtggggtgtgtgcgtgtgcatgcatgcatgtatgcctgtgtgtagaagtggcaggaggtcctgcagatgaattcctgtgccccactattgcattcctcggattgcctctgctgaggcgtttggaggaaacacggaggcgttaggcaatcttgggaggtaagggaggtgcagcaacgcaaggccatgggagcctctgtcttgtggctgctgctttgcatcagcgttccccctagagcatccagttcaaatgcctaactaatgaaactcaagaaaaatttgcttcttcacaggatgcctttgatgatgttgtgaagtattttggagaaaaccccaagacaacaccaccctctgtcttctttcctgtctttgtccggtttgtgaaagcatataaggtatatgttaaggccctccttgcccttatttctcaagcaattgccctccttgagatgtgtctgagtcccaactctctgcagaggcctcccagttcctgtggacagcagatctgggtggcattcacgagatagcagtccctagctctgtggaggctgagggacattatggtccctttctccacctagccagtcctctgcctcagccagaaaacaaagctcttggcagcccccttggggcaagggagatgctcaaagacattgctgccccattgactgttcacctaggcaggcaaggtgaagtacttgaaaatccaggcctcttgtggaattctttaatgggtagaagtgagctgtgggctgtggtgaaggtgcatgatacagctgaagttaaggagagcctgcttgtgtaagtcatagcacagggcttaggacctcttagaccagcatttctctagtatggactaaaggatggtgcttttaaggatgggcactctctgtttctttgtgtggatcagtaagtggcccttcctttaaatgggaggccctcttggacataatccagggctgtggtcttgaaaaagcctatgacgcaaagagacatgtatcagaaggatttgtccatttgagaaattacaagaaggctgttagaagattttagctgaccttggcaacacctcaatctatatcctccaggcgtatcttcatgtagcactgataacactggtggaggtaggaggaatgtttattgcagaggggaggagggatgtggcagggttctccacacttttgagaagtcctgttggaaatagggggacacttccctaacaccactaggggctgaaggctctggaaaatcattattgggccttttactaaaactcagaaagtcaaaatattcttagcccatcttccctcagcatggcttaatgtagcagtagagctataagctgctggtagaaggaacgtctgtggcagtcagggtgaacagaaacacagcacaaactccgtgtgccagactcaggatttgctcgtgatgagaaggctgcgggccaccaactgctgccgtctgcagtgcttggtagcccaagcccactggctggctgtgtttatgtgctgtagagatagtctgcgatggcccttgtcatgtgctgtgccatttttttcacataaaaacatgtaagtctaaggtcaaaagagaaaatatattttaaaatcggctaagacaggttgggaagtggctggggtttgtctcaaagcctgaggcatcagcagggatatgcgtggagcagaggaaaaaagaagctgcccttggtggtctgggctgtgttggaggtcccagcctgtccatcagcgtgctccttccacctcactgttcctccctgtgatttttcacagctgattcagtgaagcatgtgccaggcagtgatgtgactgccaggatgtttttcttgccctatacgtgatgaatagcctcctagcctggcactcacctagggactttgtaggcagaggttggggttttaggacatcatccctctcatatagaccaaaatgaaaacaaaagcaatggagacccaaatgtaaactttattactgataacagctgggctggaggatgtggtgtctgtgaccttctgcttcagctgcaaattaggtagatgacctgtccatcagttcacagcttgacaactagaggtctcttcggggaggccggcttcaaaagaaagagtgcccaagagggctgagctgaggtgagcctattcactttcttctagattcatcagactagtcacactgccttccttgggaaggagcaaggcatgggagagtccaagagtgtcactctggtgaggccccgaaaagaaatgagggttttcccctaacaataggcagaaggcagaagaatcttagatcctgctatcagaggaactctaggtaggcagactgtctctgaaaggaaaacaaaatcactgagcacagctgccaggatggtaggtgcccaccagtgtgtgggacagagactaagagaaagttcaaacagggagcgatcatcaggaaaggacttctggatgaattgaatctcagctcccagcttttaaagagatgtgacaggtagcgaagcccagaagcagagctaaatacaggcataaagtgtagatcttctcaaccttccatttattgtaattctcaactcactaaggatgcttgaagaatgactttaaaaaatcttggctgctctcatttccattaacatcatctttctggttcttttgatttacccagcaagcagaagaggaaaatgagctgaggaaaaagcaggaacaagctctcatggaaaaactcctagagcaagaagctctgatggagcagcaggatccaaaggtaagaagtgccgcactcatgagacaggtccgtgaggagaggctgagagggctcttcagagcaagccatacaaaggaccagcaagccaggtgtgcccaggatcctgaccacttccttctggtgcctggacacttggcaaatggaaatatgctcattgattactttgttctgcaaccactggaatgaggctaagagcatgtttgtgtagcatatccaagcgtatagacatctggaacttagttggatatacagagaggccacaccagatgacccagtgaccagagggcttagcatccagagaaggctttatgcagatgcccattggtgctggccttgatagctggagggacttgctagcaggaatggagggaacatttcatggagggcaacctcgttagtaggtaaagagcataaaggctggcagtccaaagttttcttcattgtgatccttggcaacacagtttaagacatctatggtcattaccagttgcctcttgttgccgtagactccagccttcttgttgctgccaggtgaagttttgtgtgttcgtcagtggaagtttttgtttccttcccagaagcttgagttctctgcaactgagcagaatgtgggatgtgtgtgtgtttttggccgaagctgcttattagtaacataatgctcaggcacattttggattttcacaaactcctaatgggtgctggcctcactaatctctgcccttctttcttctcagtctccttctcataaatcaaagaggcagcagcaagagttaattgcagaattaagaagacgacaagttaaagataacagacatgtatatgagggaaaagatggtgccattgaagatattatcacaggtaaaagatatttcttcactgtggcccatggagatcccactggcctcacctagactgggatgcatgcagattttgcagcttcttttgtccagggttgtcaagttcattagttgactttattcacacccagagtgatgcagagaggctttgaagtccatttacagcagcatgtatactgccccaatactctgcattggaaccctgtaagtttcagcagagctccttcatttaaaggatttccattgttattgatatgtcatcatgctccattttttttttcctcgtggccacacctagccacctgcctgattaataaacactgtggacaagacccattcagcaatgtactaatcacagtccatggatgctctttaagagcctctttactcattcaaagtaactgaagtcagtaggtactttaatttgggtgagccaacaggcttccagcccagggttgggaactggttttatcagccaagaattgtgttaacccagcctggttcctgtctgattgaattagcataatgctatctcctcgaaccaattctcccaaatttctgtacttccttttacagatcagagtaataacttgggcactagtaggagaggcagcaagtgacttttccttcatgtctgttgcacatgaatgttgcttataagcttccagatgcttatagctttttataatgggacagtccaataatatgcagatgtactgaaaatagtatgatgaggtcccatgtatccctcatccatttcaacaattacgaactcatggccaatcttgttacatgtacactctacctacccccatatccaacccttgacaaccaagacgtagaatttcacttggaaatatttcagtatgtatcttcaaaagataaggactcttaaaaaataaaaacaaaaacatactttacaccattatcacatctaagaatcccttaatatcaaatatctagtcattagttcacatttccccaactgtcctgatttttaaaaatagaattcctagactcttgatgtctcatttcttttttttttttgatggagtctcattctgttgcccaggctggagtgcagtggtgctatctcagctcactgcaagctttgcctcctgggttcacaccattcttctgcctcagcctcccaagtagctgggactacaggcgcccaccaccacgcctggataattttttgtatttgtagtagagatggggtttcaccgtgttagccaggatggtctcgatctcctgacctcgtgatctgcccgcctcggccacccaaagtgctgggattacaggcgtgagccaccatgcccagcctgtctcatttcttgttatagcttagtgaacattgtacattgggatcctaaatggtcaaaaccacaaatttttttctcaacagctcaaacccagggaaattaaatacataggttaggtgattaggtagattagatagattaaaaaggaagtcaataatgaattcccttccagattaaagcagtgtaggtcttagatagtaagtggctgatgaaaatgccattctctacacatggcacacacactctgcacaaatgtgcctattggtatctcagtgtacatagtgcagtggcttatagatgccccccagataaaaccttcattgtagcactctccttgcctcctccatgctgggggagaaactccaccctgagcaagaccaggagcagagctccttcctaggtaagcactttttggtctcagtgccataaaatgaagttgtagttagggaagcatccagccttgctcattaagaacttggagttcctggctgggcgaggtggcccatgcctgtaatcctaagcactttgggagggtgaggcaggtggatcacttgagatcaggacttcgaaaccagcctggccacatggtgaaaccccatctctactaaaaatacaaaaatcttagccaggcatggtggctggtgtctgtaatcccagctacttgggaggccgagacaggagaattgcttgaacctgggaggtggaagttgcagtgagctgagatcatgccactgcactccagcctgggcaatagagggagactctgtctcaaaaaaaaacaaaacaaaacaaacaaaaaccaaagaacgtggagttcctttttcattagtatgtcctccatcccaattacacctggcgttataaaatgaatgtacattttctatttgcttgatctaagtcattaatctactagaagaggggaatgagtatctgtttatagggcagtttttatcctccttggagtatttttcattttctgatccaccccaaagccccagataaattcctttgtacctttatgaactaacttgagtatatattgccttccccctttcctgcccatcttccccacccccatccccaggtatgattaacaatgcactaaccatgtactaatgcaatagatcttggctttttattctcttctgtttgtgttgtttggctgtcattttcaatgcagtgctgaagactgtgccctttactgctcgcaccgccaagcgtggctctcggtttttctgcgaacctgttctcactgaggaataccattactaaactattactctttctcacctgatgctcttaaaaggttgctacaggttttttgatgtcttatgtccccctctgtgtgtctgtcagggcccaccaacatgctagcatggaattgccatctccatcatgttatattttgtgttgttctcatgctgcatggttttgcatttcaattattattgctcactcactggccactttcaatacatgtatgtattcacattgctgtaacagtctgggtgtgtttgacagctgaattcatagaattgttcacagaaattttcagaaaaatagagcaaaaatattaagagcacttctttgagaatcagtattggtaccaagtagattgcttataagatttttgagctaatgtccttcaacatatccattaataacaataactgctatacctaacatgtattaagaacttactgtgttcaggttggatgcagtggcacacgcctgtaattccagtactttgagaggctgaggcaaaaggatcacttgagcccaggagtttgagaccagcctgggtaacatagggaagccccatctttacaaaaatcagctgggcatggtggtgcacacttgtagtcccagctacccgggaggctgaggtgggagcattgcttgagcccaggaggtggaggttgcagtgagtggagatcccaccaatgcactccagcctcggcaacagagtgagaccctgtctcaaaaaaacaaaaacaaaaaacaaaacatactgttctaagtaggtttacagatattaacctagcccttttatcctatacccagttaatatgctttgatagcataatcacctgccatatgaaagtgctcaggaatgcgaagtgctctaaagtgcaaaatgacttgcagaaggaactgtgaactatgcacagctgcaaatcaggcctttcttaactctcttatacgtccatagcatgatggaactcgtaatatgagcttaacacagggagcccttttaacctagcttgtatatgtagatataggcaatccatagctttatgtcaccctactttagtaggccacctctattccttctgaatgtcatgcccatgttcaactatcagtaattccatgttggagcaaagctgtgaggcaggacatgaatacaaaggcttaggtcctcccactgtcttatctcattcacgcatcttcaccggtagctctgttccatgtcaaacccaggctatttcttctgtgatcagatcatatcttgacctgcttctttggtcaggatgatggcaccagaaatactaacagcaaatatcattggaaaatgccactgtttttaaattgggggggaaaaaagggtcaaacttttcaaagtaacctcctgggcacagtttttgatgcctaataagaaacgaacttctctccagtgtctagttgattagaaaagagacaagggaaacacatactctaattggacgtagccattgactcctgtgctgagattgacatggaattgggtatgtgtttattttgtggcataactattctatgaattgcacttatgtatgttcttctatctctgatatcaaaggacatagagtgtcattgcctgctctgcagtgtacttacccaccagtgcttattaacaggctagaaaactgtcatctgcttggctgatgtttgctgtcagttttgctgttggactatatctatctttctggagccaatcttcaaagcagcttggaactgggtggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactggtgagaatctgaccagggagtttttgtacctcacattccaatgatgcagggattgagcctctctgttggactctttctcggcctgcttttaagttctaagtgtgatggcttgggcaagggtatttgctgatgattgtatttgctttgagtgttgggctgtccttcccttacccctgtcttggcctttgagttactcagttaaacccattttgatctgaagcgactgaaagcaggtcctggccaggtaacattacagcctttgaaggattaagatctttagaactaattgctcagaggatgaagaaccacaaagctgcatatgaggcaaaagtgtaattctggcctttcattaccagtgtgggctaggaagcagaggcttgagaggattggggtatgcaaaactattttttccttaaatttaagagtagaggctgggcatagtggctcacacctgtaatctgtaatcccagcactctgggaggccgaggtgggcaaatctgttgagttcaagatcaccctgggcaatgaagcaaaatccccatctctacaaaaaaaaaaaaacaaacaaacaaagttagccaggcatggtggcaaatgcctgtagcccagctacctgggacgctgagatgtgtggatcccttgagcccaggaggtggatgctgcagtgagcagagatcaccactacactcgagcctcagtgacagagactgtcctcccctcacaacccccgcccacccccccagaaaagagtagggcagggtcacacaaattccaatgagtcaaggagccaggaaggtaacaggcctggtaggaactgtgctgaacctagagcacagatcttagctccaacttctttttgctgtgtaggaactggggcccggttttgccagatcttccagtttttcaaaagaagccagaaaccctggtctttatgttaattaccaatttaaacaccaggaaactgtacatgtgcggggggtgggggggcacagtggagcaaacattctgtgggtcaaatgtggtccatcagctgcattttcaacttgttgagtagataaagggatacaaaagattcaatttggtttaattctgttatttgtttgtatttccctttctaaagatagcatgtattctagcagaagtcaacaatactaagttaatgaaagggaagtaaatactaattaaacaggaaaagtataaagcctgctttacttttttcactatgccctgacttcatcaaagggaggctgcatagcctagcctgctggctagctacctgacttactcaagaaagcatgccttcatactgagttcttgtataaaattcctctgctcctcccacttcatcctgacagagcaatgcctatttggactggtatgcagtgattgactcattcatttaacaaggattttcttatgcaggagggcccacacaactacttcttgctgacgtaacataaaaaatattgggtggtagagctcggtagtccccacttctcaggaggctgaggtgggagaatcgcttgagactggttcaagtctggcctggacaacataacaagaccccatttcttaaaaaaaataggtggcagaaaaggatgccagggaatagattattattttggtttagatttaatggttaattgaacatcattttgtttaaaatttacaaaataataaactcagctagcttaatggaatgaaaataatagagcccttatctgcaaactgaaggtctttaggttcttgttaaaactgcgaggaaaagatgggacaggacagtctgctttattaattttgcagtttaaaatttattgcagttactatttattcattcaggcttccagaataaaaacaaaacaaaaaaattaagctacagctgcttctaatttaagaaacatttcaaaataagacttcagctagactctggccagtgacagaaataatctatgtatttttctctcaaagtcctagaatcctaccagtattacatcctgttttgtttgattgtaaatattgaaggcaaatgttttatgtctttgattcaatgctcagtgagtttgaagggcccattagctgacttttctacacaagctgctttgattggctgccagctggcctttgtcctgcttagacacatgctattaaaggttgctattctctcactggcactctcccctttacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactattctgtaa

SEQ ID NO: 2402 - DNA, 605418 bp, Homo sapiens
tagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgcaccccctacccgccctttccaaagatgtctgatctcaaagaaggtgagaagtgaatgagcagagtgaagagtttattttcttctttttctgcctgtttgaaaccggaaccctacctagctttgattttaaagtcttgctgaaaaataacagaccaagaacggtgcgccataggtaataattgataatgggaagggtgagataaacttaaggagacttgtttgtgttccaaaataaccactgcgtcgaagaatttcagtgaaatatattgattttagggagcttgggattaacatggagctatagaataatatgtatatgtatatatatttaaaaacttacaaatttttaattttaaaaactgtctcaaaattgatttttttcttaaaatcaagaaattatagcagtgttcgtcaggggaaaattgattttaaggtgtgttaacttatcctatgtaacttgttttaaaccaacttttcccacttcatgaaatccacagcctttaaaatgtgtgtaatgtatttactagtatgctatacactcttttagaaactgatatcaaattttaaagatgcataattactgagaattaggatgaaagtcaaaaatataccttaactcatacagcatgattagaaattcttactgaagttatgattactttaaattactaaagtgttttttctccctttgtgtgtcatttatcaaaataattagatcaaacaacaacaacaacaaaaacccccaaaagatcataaggaagagaaaaaatgatatcttaggcaggatacaaatgagcaccaataatttattctgggttaatttcatagagtaagtggcgaactattccgcctatataatttgagaaaaatgtaggttacagggagatgtcaaatagactctgaactgtgttataataaaatatattaaatatatgtgattaggtataattttctggctctgccattaacacacaatgacttcggacattcacccatccttccaggcattagtttcttcatttataaaataaagtaattggactaggtgattgcaaaggtttatttcagctaaaaatattatatctctcaaattattacttttagaagaagtaaccaagatacacagactttaaaaatttacaactgaagtacgactgaatcctatctccattttctcatttccatgatgaataaatatagcagtcactccttaatgaatgcctgctatgtagtgaattcttagaaaccctttacataggttatcttatttaacacaataccaccataaattgaatagtagtatatcccaatttatagataatgatactgaagaatgaaaagtttaagctccttgcccagagttccagtttataagaactgggtcaaatattttttccaaatgctcttaggacctatactatactgaatgggatgattaaaagctaaaattgcctataaactgaagtaatcttggactactataagagtctataatggggcaaaggtaaattatgtaacactgagtcttcataccattaaatatataagtgctgtatcagtctccatttattatatcttaaaaagttacatatttatgctgtatatttattaattgaatgccagttgtattctcagaaagtgatcatatgagatatatttgtaacacaaatggttttatggtaataaatataactgctagaaaaaatgtgagagggcagaagctagtattaagcaaatgctggtattaagtatgtcagatgtctttctacttgaaggtactcatgcttgagacaaaaatgcttacacccaagggaaaagggtgttcagagtagaattagctgtgactaaactcttttgttcatatcctatgatgaatcataatagtatgtcacatttattgaatatacgttgtatgccaggaattctcttaagccctttattagtataattttatattggatcatgaattaaattgtattatcctgatttgcaaatgaagaaaccgaggcagagagatctatgccctgggaggacccacaaaaaaatactttttatcttagattaaatgtgtgatcgttcattgttctgaaattcttaggctgtgaatgtaacatgaaatcttgaagcactggaaggagacttggagccaaactaaaccaacctctttattttatatttgaggtaaaagagacctagaacagttaagagacgcacttaaggccacatattttagtcacctatacattctcataaactattaggtaagaagtatcctaatgggtaaacttggttattaattgtttgatttattgtcacgcaaacaaatgccacctcatgccgtttcttatattgctgccctacttttatttaaaatttcaaggttgccccaattaggatgcaaaatccttgaagacagtgattgtattatatatttctcttatatagtatctatagggttcagcatagtggttaacctattgaataagttgctttgttgcctgtttgcctttgataagtcattattttatgcaccaggtctgaaatctacacagtggaagcacaatgccatcaccatttttcacttcatgtagagggcaactagacaatttatgatgcttacaaagtgtaatgagcttcttagataattatttaatttggttataaaatgcagtgtgttaccatggagagatttggatgtgtatttccctgattttggggggacaaattgcatagctaagtatcacacacagttcaatttacctccccaccactctgttcttttgatttggaaataacttttttttctgagtgcaaagataatgcaaagtcatgcaggaaattcagacagtaaagaaataatgaaaaaatcaccagaacctccccagtctaaaggttttggtgaacagccagccagagaggtctttcttctcttaactcctgtcgaatcagggtgagagctgaattatttattgaaaccatttacagtaaagttctatttagttttagtattccattactcctgggcagttcagactttatgtaaataaagatatttgttgagcaatgaagataaacatactactaataaactagagtctactccatgtagaatggagtagtacagaaagttgatttcctcacatcgtatgcctaattttttcctttcacaaggtaggtttgggagcacagggagcatcttttgcatgcatggagggttctccaatatgccaggatcttaggccacacatgaagccacagcaccccagctctgttgccctgagtgaggtgtggcagaggaggagaagggtggagctgaggcacaagcggctgtggtaatacaaaggctgtgttttccgattctactgtgacacactatacacttaaaaatgtaccagaccaagtccctccccgagctgctgggcaggtggtcatggggcccttttctggtgcagtcacgcgtaagtctggctttacctcaaagccagggcaagatgctgatagggcatttctcattcatttattcaggattctgaaaacctagaatggaccctcttttatattaaagggaaacactggctgctggaatcattgtccataaatgagtcttgaagtaatactcacaaaattattaagtataaagaaaagttggggcatctctttgagagagacaatagctctttctgtatgcattcggatgtaattacattgaaaatatttgttttgaagattatgttttctggttattttaatttcataaatctatttgttattcaaaacttctttccctaggcatattttctttgtttatactatacatttgagcagagagatttttcatgcttcactttattaggggcttaacatggctttaatccaaccatctgttcgcatcttggcacatcagcatgtctgaggtgctggtaggggccaaataaatttcccacattttaaaggttagggaaagagctacctttatgaatagatttcaaatgattctcagcaagacaatggtatagaagtggagtaaaaatgcatttcattctctgaagcacaaggtcccctgtctgtcttcagttttgctgaaaggcaattagcatttcaactagccaatttggttacatgcaacgaagtacttgggtttataatttgctgctctgtctgaggctgttgagtgctaggtcttatgtaatcctttccaagtagccttctctccagcatagttattgttgctggtcttaaataactaatcaacagagagttttccttgccttcaactgtagggtgccatagggcaaggaaaatgaaataccaagcaaataaggggatgactgtaattataaatagtcattattgaaatgtggcacaggttgaaagacatacaatagcttcaaataaaatgcaactccaaaaagtcattgtgtgcactgttaatggtttctcatgcagtatgcacaataagcatagggcatacatgctgggattaattcagttaacatgactcaaaattaacaaagaaggtgcaattcctttatgccagaaagaattttgttgggaataggtttaaaagagaaaagattctaaagtgttacaacaaatgaataagtgctctgaggcatattgtggaaataaaggttttgtactgtgtgctaattgaaaataagatttttgtcagcttctttagtcgtgaattttgacaattaggtagtattaatatacttcatgtatacactcatatttctctgaaggagccactgtatggtatggtaatccttttgttaggataattaggatgatattttcctgtaatccatgtcatggaccagcaattcagtgtagctcatcttttggtgtaacactgtttttgcatagatgtacttgtgtaattatttggaggtaaaatagtacatttttcattcttcaagtaatgtttaactgaaagaaggcataatagaaagaagtgttttagatatgtcttacaagtgatcagtataattttgagaacatatgtgaaagaattgattttcatttatatttccaatctgcgattataaagcttttgttacggttatagttagaatcattagttttatttaactaatttcaacagtgttgatgagcaggaatgaaatgaagagagcttgttccttctctggcagactagtaagctaaggttggagagtgttctggaaaaagtgggacttgattgggactttgaaaaatggtggaagagagggagtggaaaaaggtagagaggactgggactagcttagattaaaggtgcagaagcatgaataatacaagtgttttgtcccagacacgtattagattaacctggctggaaatgttgaaagaagagaaagagatagctggaagtgcagaggtttgattgttttttaaattgatagataattcacatatgaaaaacaatcacctttcaaagtacacatttccatggcgtttaatatatatatatatttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactgcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccggcgtttaatatatttaaaaagttgtggcctgggcgtggtggctcactcccgtaatcccaacactttgaaaggccaaggtgggcgggtcacctgaggtcaggagtttgagaccagcctgaccaacatggtgaaaccctgtctatactaaaaatccaaaaaaattagctgggcgtgttggcgggcgcctgtattgccaactacttgggaggctgagtcaagagaatcgtttgaacgcgggagacagaggttgcagtgagctgaaatcccgccactgcactccagcctgggcaacaagagcaaaactccatctcaaaaaaaaagttgtgcaaccatcaccactgtctattccagaacattttcatcacctccaaaagaagctctctacccattagcttttgctctctatcccacctttctccactgccttccaattcctggaaaccagtaatctattttctatctctatagatgtgcctattctgggcattttgtataaatggaatcatacaatatgtggccttttgtgtgtactttcacttagcatgatgttttaaagattcatccatgttgtaccatgtagcaatacttcaatccttttgtaaatgccaaataatattccagagtatggatatgccacctttcatttatgcatttataaatagatgggtgtttgcattggttttactttttgactattataaataatgctgctttaagcatttgtatacaagttttttttgtgctgacataagttttttgttctcgtagtggcccatctaggagtggaattgctaggtcatattgtcaccctgtgcttcattttttgaagaatttccagctgttttctaaagtgtgtttaccattgtatatgcccaccagcaatgtatgagagttttgatttctctctgtctttttatgttaaccatcctattcggtgtgaagtggtatctcattcgggttttgatttgtatttccttaatgactaatgatgttgagaaccttttcatatgcttgttggtcatttgtgtatctcctttggagaaatttctattcaggttttttgcccattttaaaaataggattttgtttttgtttttgttttttattgagtcataagagttcttcgcatactctagatactaatcccttatcagatatatcatttgcaattttttttcattgtgtgggttgtctttttactttcttgatggtgtcctgtgaagcaaaatgtctttaattttgttgaattaatttatttaactttcctttggttgcttatacttttggtgtcacagctaaacaactgttgcctgatacaaggtcacaaaaatttatacccatgctttcatctaagagttttatagtttaagcttttacatttaggtttttattccattttgtgttaatttttaatatgatataagcttccttcatttgcacatagatatccaattatccaggttccatttgctgaataaatcattcttttttcattgaattggctaggcttcactgtcaaaaattaattgactataaatgtatggttttatttctggactcaactctattttgttgatctagttttctgccagtacctcacagtcttgattattttacatattttgttaaatttcttcctaagcattttattgttttattaattatgttgtaaatgcaattattttcttaattttatttttgaattcttcattactaatgtatagaaataacaattgattcttgtatattgattttgtattctgtaatcttgctgaactcttttatttttttatgtatggtgtttttaggattttctatatacaatatcatgtcatctgtagatatagtttaatttatcttttccaaggatacgttttattttttttcttgcctaattgtcctgcctagaacttccagtaaagtgctgaatagaaataatgagagctgagatccttgtcttgtcctgtgatcttagagagaaaacttttggtctttcagcattaagtatgatgtggatacccattatagataccctttgtcagattggagaattatccctttattcctaatttgtataataaaaagatgttgatttttttcaagtgctttttttgtgtcttttgagatgatcatgtgattccctctgctttttttctattaatttggtacattgcattaattggttcttgatggtgaaccaatgtagcattcttggatagatctaatttggttatatagtgtatcatttgttttatatgttactggatttggtttgctagtattttgttaagagtttttgtgtcaatattcataagggatacttgtcttagtttttttcttggttctttttttccataatgtctttgtctggttttagtatcagggtaatactggccttataaaatggtttgggaagtcttgtgttttatatatatatttttaagtttgtgaagggttgatgttaattattccttaaacatttggtagaattcaccagtgaaaccatctggtcctggactttcttcatggtaagttttgcaattactaattcaatctatttaattgttgtgggcatattcagatttttaatttctttttgagtcaattttggatgttcgtatcttcctagggatttgtttacttctaggttatctagtttgttggcatgtaattgttcatggtcatgctttatatactcagttttatttctgtaaagttggtagcaatgaccccttttgaatttctcattttagtaattcaaatcttcttcccttttttcttaatctagccaaagttttgtcagttttgttatcttttttttttttttgacagaatcttggtctgttaccccggcgggagtgggagtgcagtggtgcgatcttgtctcactgcaacctccgcctcctgggttcaagcgattctcctgcctcagcctcctgagtagctgggattacaggcacctgccaccacgcccagctaatttttgtatttttagtaggacagagtttcaccatgttggccagctggtctcaaactcctgacctcaagtgatccacccgcctcggcctcccaaagtattgggattacaggcatgagccaccatgcccagtcccttttattatcttttcaaagaaccaacttttacttttgttgattttctctgttgtatttctattctatattttatttgttcccactcaaatattttttctttgtttccttctgcttgatttgggtttagtttgcctgtttttttctactttcttaaggtggcagtttaggttctttatttgagatctttcctttttttaatatatgcatttgtgcctgtaaattctcttccaagcattgctttaggtgcatcccataagttttggtatgctctgattttattttcattaatctcaaattattttctaatttacatgtgctctcttttttgatcctttggtcatttaggagtgtgctgtttaatttcaacatgtttgtacattttgcacttttttctgttattaatttctaatctcattctcttatggttggagaatatactttgtatgattaaagttctttaaatttattgagacttggtttaggaccttacatattatctcttctggagactgcttcatgtgtacttgataagatatgtattctgctgttgtggggtgaagtgttctatagatgtgtattaggtctagttagtttacagtattttttaactcttcccttttcttgttaatcttttatttagtcgttatattcagtattgaacatggggtactaaagtcactaactataattgttaaattgtctgtttttcccctcaatttggtcagtttttaattcatgtgttttgggattggctttttatgtgcctgtaggtttacaattgttacatctttctgataaattgagccctttatctttataaaatatccttctttgtctgtagcaacattttctgtcctaatgtctattttgtccaatattaatgtcttagtccattttctgaataccagagattgggtagtttataagcaatagaagtttatttgacttacagttttggaggctggaaagtccaagaacttggctctggtatctggcaagggcttttgtgctatgttattccaggatggaaagttagagggcaaacaagcatgtgagacagagaggggaaattagaccaaacttatccttttatcaggaggccactcctgtgatgactaacccacccccctaatagcagtattgttccattcatgagggcaaagccttcataatgtaatcacctcttaaaggtcctacctctcaacaccgttagttacaatggcaattaaatttcagtatgagttttggagaggtcattcagaccatagtaatgaatatagtcacttcagctttcttttggtttctgtttgcatgatatatatatatatatatatatatatatatatattttttttttttttttttttttttttttctcattcttagtttcaacctgtttgtggctttgagtttaaagtgaatcacttataaagagcatatagttaggtcattttttccaattcattctaatgacttctgccttttaattggagtatttaatccagtaatatttaatgtaattactgataaggtaggattgatgtctaccattttgctatttgttttttgagtctatgtcccttttcatcccctgttcctcttttactgccttcttttattttacatagatattttctagtgtatcattttaattttgtggttgtttcttttattatattcttttcattaattttattattggttaccctggggattacatttaatatcctaacctataataatctagctcagattaataacaacttaatttcaatagcgtgcaataattttgctcctatatagtttcatttctgcccctgctttgtgctgttattgtggtacaaattccttttttatacagtatatactctttagcacaaatctattattattgctttatgtagttgtcttttcaatcagagaggctaaaagtagttataataaaagtacatttatgccatcttttatatttatctgtcatgtgaccttttctggcactttacatttttttctgtggattcaagttactctctaatgttctttcatttcaccctgaaagactccttttagtatttctggaaaggaaagttgctaaccacatagtgtctcactttttgtttatccaggaaagtcttaatttcttcttaattttggaatgacaattttgttgcatatagtatccttggtttattgtctttcagcactttgaatacatcactgccttctagcctcctaggctagaggagaaatcagatattaatcaggatatcacttttatgtgataattttcttcttccttcctctttcgtgattctctctttgtcttttgctttggcagtttcgtatatgtctacatgtggatctctttgtgtttattttacttagagtttactgagcttcttagatatgtagattaatgtttttaaatcagatttgggaagccttcagccattatttcttcagccatatttctttaactactttctgttgttagtcttcttctgggagttccactaggtctatgttggtatattttgtggagtcctataggactctgaggctctgttcatctttcttccttattttgtctttttgttcctcagcctgggtaatttcagttactttcatgttcactgattcactcttctggctgcttaaatcagctgttgagcccctctgtgaatttctcaatgtagttattttacttctcaactccagatttctgttttttttttttaaactatctttttgatatcattcatttgatgagaaatcatttttatactttttattgtttatatagacatgatttcccttagttctttgaatatatttaaaacagttgatacaaagtctttgtctagtaagtctaacatctggtatgttctccagggacagtatttatcgattacttttttcctgtgtattgctcatattttcttgtttctttccatgcttggtatttttcttttttaagaaactgtatggctttgaagttcagattctccctcttcctagggtttgttgttgtccctgattttattgttgtttgtttagtgaattttctgaagtctttttaaagtatgtactctttgttatgtgtggccattgcagtctctgcttggttagcttagtggtcagctaatgagtggacagagattttcttaaatcctgggaaacagtaagtctcccagtttttgcttgggagctccatgtgcgtgttgaagaatacctttagcattcagccagaaaattttcaactctgcctaaccttcacttcctctttgcacacagcctcaaaaccagccagaggtgagaatgtagggcttttacaggtttttcatgaacatgtgcacagccttatacttgtgtgtcatcttctaggttctaggaatatgtcagaaatttttaaatttgcaataaatgtctcattgcccagtctttccttttaagcttttagttagcttattgttttcccagctgttatctattacctctggcagctattatgttacataattgtctataaacatttttgacaagtgcctctaaggaaaaggctttcaaatactgggcaaactttgagtcaggtcaaataaagatactgtggtgagtgaagtcttcaagaaaccactagatagatcaaacaatgacaactctgtgaattgggctttgatggctttcctaccccattctgttcccttcagtggctgccaggatgctggttttaactgttattgcaggctgttagtttttaaggtgactttggaggctgggagagttgtgtgggaataggtcaagtttaaatgtaataaagttcactgatttcctggagattcagctgtatttctttaataaatgctccttggaatcctgcaagcccttggttaatttctgaagttctgcaagcattgattctgacagtttttgctagttttctcattatttttatggagcagaggattttaggaggtccttaccctgacatttgcactggtttggattttcagagcaaacattagggcttccccctacctcttgttagatattatggaatcactgtcagtttttgaactacagactgatataaaaatagtcttttgaagactattctgttggtaatgtagagaaggctgattggaatgggcagaagagagcaaattaataaaggcaataacagtggatgtatgttgataagctcttgttttgggtagcagcaaaacaatgttaaatgaaggataaaggaggcatttaaagagggtgtcagaagtacttggtgaccttttgcatgacttctgtatttaagcaggtttgatgtcaataatataaaataaaataaagtaaaataaaataaaaaagttcttctgaagaatatgtcatccatccagtcatccattcattcaccaaatacatgtgaatgaactggtacgaaagcagaaacaaagaccaatggaacaaaatagaaaacagaatagaaataaaactgcacacctacaaccatcttatctttgacaaggccaacaaaaacaagcaatggggaaaagactgtctattcaataaatggtgttggtataaatgtgcacacatgctcacacacgcacacgcacgtgcacacacacatgaattaacaatatctaacaaattatgctttgatggatgtagagaaaaaagagtgaataattttcaaaggaaaaaagttgagaccgtaggatacgtgttttgggactagccttggaaaagggaaggatctcctgtactgtgagagaggagaaaataaagtaattgggggaaattggaattagaatggactggataggaggaaggatacgtcagagaatgtattcatgcccttcctcacctaccaggaagggtggataaaacagacaggtggcatttaaaaggaatttgtccccattcttctgtatattttgttaaactcaggatcaagttatggggcaaatgcatcacagatggcttgaaggtttcccttagatctctccgtgtatagatctactaattaagtaagaaatttaaggccaccagattgtgaggaaacacaataaagtaatgctttccaattcagtttttcccttcagcactgggatgtagcttttcctaagaaaggaagtatggtattggttggcataatgattgagctctccaggatattgctaaaatcagaaatgtggttgaatattatctgattcccactgaatccattccctgatggcttctgtctttttggtggagacttatctaaattacagtcatgcattgcttaatgatgaggatatcttctgagaaatgtgtttttaggtgattttgtcatcatgcaaacatcatagagtgtacttacacaaacctagatggtataatgaaccacacagctgggctatatgtatatcctatggctcctaggctaaaaacctgtacagcatgctactgtattgaatactgtaggtaattataacaccaaggtaagaatttgtgtatctacacatacctaaacctagaaaaggtgtagtaaaaatacaatattataaccttatggaccaccatcatatacctggtccatcactgactgaaacatcattatgcagtctatgactgtatgttggatgaactgccaaaatgagaaataaattattgttttcttctgagacaaattattgaagttttaaaatgttgtttttttaaatgagagaaatttaataaatcacttgattgagaactgggcattaagtaaaaattaagtcccatttaccaaagcataatttgtcagatattgttcattcatgtgtgtgtgtgcacgtgtgcatgtgagcatgtgtgcatgtttataccaacaccatttattgaatagagagtcttttccccattgcttgtttttgttggccttgtcaaagatcagatggttgtaggtatgcagctttatttctattctgttttctattttgttccattggtctttgtttctgcttttgtaccagtaacaagctgttttggttactgtggctttatagtatagtttgacatctggtagtgtgatgcctccagcattgctctttatgcttgggattgctttgtctattgaggctctttttcggttccatgttaatttcagaatagttttttttttttaaattctgtgaagaatgatgttggtagtttgataggaatcgcattgaatctgtaaattgctttggtcagtatggatgtttttatgatattgtttctttcaatccataagaatagaatattttttcatttgtgtcatctgatttctttcagtaatgttttgtagttccccttatagagatctttcacctccttggttagctgtattcttaggtatttcattttctttgtggctattataggtgggattctgttcttgatttaactttcagcctgaactttgtgtatagaaatgctactgatttttgtacattgattttgtatcctgaaagtttactaaaattgtttatcaattctaggagcctttttgtggagtctttaggattttctagatatagaatcatatcgggttgacgccagcttcatagagtgagttagggagaagcccattctcctagatttttggaattagtttcagtgggattgatatcagttccttgtacgtctggtagagttcagctgtgaatccatctggtccaggatatgttttggttgttaggttccttatcactaatttaatttcagaagttgatagtggtctgttcagggtttcaagctcttcctgattcagtcttgggagattttgtgcttgcaggtgtgtatccttttcctctagattttctaatttgagtgcatagagttgttcatactaggctctgaggattttttatatttctctggaatcagttgtaatataacttttgtcatttcagattgtgcttatttggatcttctctttctgtttctttgttaatctagccaggggtttatcaattttatttattttttttcaaagatccaatttttggtttcattaatcttttgaatgaattttgcatcttgattttgttaagttctttaattttagttatctcttttctgtgggtagctttgggattggtttgttctttttttcctagttttttttaggtgcaaagttatattgttgatttgagacctttctaactttttttttacttttaaaaaagacattttattttattttattttgtgttatgttattttattctttgagacagagtctcactctgtcacccaggctggagtgcagtggcatgatcacagctcactgcaacctttgcctcccggattcaagcaattctcatgactcagcctcctcagtagctgggattacaggtgtatgcatcacgcccagctaatttttgtatttttagtagagatggggtttcaccgtattggccaggctggtaaaaagggatattttaatacaaaggaagtagtcaaagaattctgagctcagattgcaggatggcccttttcaaacagaggcagctggccgcttaccttgccttcattttccaggggtttctcctcccatgaatggacagcgaaagcttcatcctagaccaatcctgtctccacgatggctttggggacctgccttgccccagggttttgtctacaggcctggcaactttgaccatgagaggcagactccctctaactggaggctgacaagtggaaactgttcggattattcccagagggcttacatgggggcgggtcatcctggtgaattctcaggcatgatccaaatctgcctcctaggcacagaacaccattctccagggtcgcagtgctgcctggactccaggaagccagtctctgctgctcctggtgtgcccctaggggtggccgaggttagtaaggcctcccctcactggagcagaagacaaagtgatttatcttgatccctgtgaaatggttgcacaaccccaagagcctgagactcatcaaagaatgtccctctttatttcctgttcattacattgccatgcgcaattcagacaagacatcccagcactgcttccagtcctctgcttaagggtgggattctattattattattatactttaagttctagggtacatgtgcacaatgtgcaggtttgttacataggtatacatgtgtcatgttggtttgctgcacccatcaacccgtcatttacattaggtgtttctcctaatgctatccctcccccagccccccgccccacgacaagccccagtgtgtgatgttccccgctgtgtgtccaggtgttctcattgttcagttcccacctatgagtgagaacatgtggtgtttggttttctgttgttgtgatagtttgctgagaatgatggtttccagcttcatccatatccctgcaaaggacatgaactcatccttttttatggctgcatactattccatggtgtatatgtgccacattttcttaatccagtctatcactgatggacatttgggttggttccaagtttttgctattgtgaatagtgccgcaacaaaaatacgtgtgcatgtgtctttatagtagcatgatttataatcctttgggtatatacccactaatgggatcactgggtcaaatggtatttcttgttctagatgcttgaggaatcgccacattgtcttccacaatggttgaattaatttacagtcccactgaccaacagtctgaaagcgttcctatttcttcacatcctctccagcatctgtttcctgacttattaatgattgccattctgactggcatgagattgtatctcattgtggttttgatttgcatttctctgatgaccagtgatgatgagcattttttcatgtgtctgttggctgcatcagtgacttcttttgaaaagtgtctgttcatatccttttgaccactttttgatggggttgtttgttttttttcttgtgaatttgtttaagttctttgtagattctggatattagccatttgtcagatgggtagattgcaaaaattttctctcattctgtaggttgcctattcatgctgatggtagtttcttttgctgtgcagaagctctttagtttaattagatcccatttgtcaattttggcttctgttgccattgcttttggtgttttagtcatgaagcccttgcccatgcctatgtcctgaatggtatgctgaagttttcttctagggtttttatggttttaggtcaaacatttaagtctttaatccatcttgaataatttttgtataaggtacaaggaagggatccatttttcagctttctacatatggctagccagttttcccagccccatttattagataaagaatcctttccccatttcttgtttttgtcaggtttgtcaaagattagatggttgcagatgtgtggtgttatttctgaggcctcttttctgtgccattgatctatgtatctgttttggtaccagtaccatgctgttttggttactgtagccttgtagtatagtttgaagtcaggtagtgtgttgcctccagctttgttgtttttgcttaggattgtcttgacaatgtgggctcttttttggttccatatgaagtttaaagtagttttttccaattctgtgaagaaagtcagtggtagcttgatggggataacattgaatctataaattactttgggcattatggccattttcatgttattgattcttcctatccatgagcatggaaggttcttccattagtttgtgtcctcttttatttcgttgagcagtcctttgtagttctccttgaagagatccttcatatcctttgtaagttggattcctaggtattttattctctttgtagtaactgtgaatgggaattcactcatgatttggctctctgtctattattggtgtatggaatgcttgtgatttttgcacacggattttgtatcctgagactttgctgaagttgcttatcagcttaaggaaattttgggctgggatgatggggttttctaaatatacaatcatgtcatctgcaaacagagacaatttgacttcctcttttcctgattgaataccttgtatttctttatcttgcctgattgccctggccagaacttccaacactatgttgaatagaagtggtgagaggggcatccttgtcttgtgctggttttcaaagggaatgcttccagtttttgcccattcagtatgatattggctgtgggtttgtcataaatagctcttattattttgagatacattccatcaatacctagtttattgagagtttttagcatgaagtgctgttgaattttgttgaaggccttttctgcatctattgagataatcatgtggtttttgtcgttggttctgtttgtgtgatggattacgtttattgatttgtgtatattgaaccagccttgcatcccagggatgaagccgacttgattgtggtggataagatttttgatgtgctgctggattccgtttgccagtattttactgaggatttttgcatcgatgttcatcagggatattggtctaaaattctctttttttgttgtgtctctgccaggctttggtatcaggatgatgctggcctcataaaatgagttagggagaattccctctttttctgttgattggaatagttccagaaggaatggtaccagttcctctttgtacttctggtagaattcggctgtgaatccgtctggtcgtggacttttttggttggtaggctattaattattgccataatttcagagcctgttattggtctattcagagattcaacttcttcctggtgtagtcttgggaggttgtatgtgtccaggaatttatccatttcttctagattttctagtttatttgtgtagaggtgtttatagtattctctgatggtagtttgtatttctgtgggatcggtggtgatatatcattttttattgagtctatttgattcttctctcttttcttctttattagtcttgctagcggtctacctattctgttgatcttttcaaaaaaccagctcctggattcattgatttttttgaagggtgttttgtgtctctgtctccttcagttctgctctgatcttagttatttcttgccttctgctagcttttgaatgtgtttgctcttgcttctctagttcttttaattgtgatgttacggtgccgattttagatcttccctgctttctcttgtgggcatttagtgctataaatttccctctacacactgctttacgtatgtcccagagattctggtatgttgtgtctttgttctcattggtttcaaagaacatctttatttctgccttcattttgttatttacccagtagtcattcaggagcaggttgttcagtttccatgtagttgtgtggttttgagtgagtttcttaatcccaagttctaatttgattgcactgtggtctgagagacagtttgttgtgatttctgttcttttacatttgctgaggagtgctttggttccaattatgtggtcaattttagaataagtgtgatgtggtgctgagaagaatgtatattctgttgatttggggtggagagttctgtagatgtctattaggtccacttggtgcagagctgagttcatgtcctggatatccttgttaaccttctgtctcgttgatctgtctaatgttgacagtggggtgttaaagtctcccattattattgtgtgggagtctaagtctctttgtaggtctctaaggacttgctttatgaatccgggtgctcctgtattgggtgcagatatatttagtatagttagttcttcttgttgaattgatccctttaccattatgtaatggccttctttgtctcttttgatctttctttattggtttaaagtctgttttatcagagactaggattgcaacccctgctttttttttgctttccatttgcttggtagatcttcctccgtccctttattttgagcctatgtgcatctttgcacatgagatgggtctcctgaaaagagcacactgatgagtcttgactctttattcaatttgctagtctgtatcttttaattggggcatttaacccatttacatttaaggttaatattgttatgtgtgaatttgatcctgtcattatgatgttaactagttattttgcccattaattgatgcagtttcttcacagcattgatggcctttacaatttggcatgtgattgcagtggctggtaccgattgttcctttccatgtttagtggttacttcaggagctcttgtaaggcaggcctggtggtgacaaaatctctcagcatttgcttgtctgtaaaacttcctgttggggaagttctcctggataatatcctgaagagtgttttccagcttggttccattctccctgtcactttcaggcacactaatcaaacgtagatttggtcttttcacatagtcccatattttttgaaggctttgctcgttttattttactcttttttctctaaccttgtcttcccgctttctccttcacttagtttggctggatatgagattctgggttgaaaattcatttctttaagaatgttgaatattggctcccactctcttctggcttgtagggtttctgccgagagatccgctgttagtccgatggacttccctttgtgggtaacccaacctttctctctggctgcccttaacattttttccttcatttcatccttggtgaatctgacagttatgtgtgttggggttgctcttctggaggagtatctttgtggtgttctctgtgtttcctgttggggaagttctcctggataatatcctgaagagtgttttccagcttggttccattctccctgtcactttcaggcacaccaatcaaacgtagatttggtcttttcacatagtcccatattttttgaaggctttgttcgttttattttactcttttttctctaaccttgtcttcccactttatttcattaatttgatcttcaatcactgttatcctttcttccccttgatcgaattggctattgaagcttgtgcatgcgtcacgaagttcttgtgccatgtttttcagctccatcaggtcatttaaagtctcctctacactgtttattctagttagccattcgtctaaccttttttcaagtttttttagcttccttgcgataggttagaacatgctcatttagctcggagaagtttgttattaccgaccttctgaagcctacttctgtcaccttgtcaaagtcattctccgtccagctttgttccgttgctggtgaggagctgtgatcctttggaggagaagaggtgctctagtttttagaattttcagcttttctgctctgatttctccccatctttgtggttttatccacctttggtctttgatgttggtgacctacagatggggttttggtgtggatgtcatttttgttgatgtagatgctattcctttctgtttgtgagttttccttctaacagtcaagtccctcatctgcaggtcaattggagtttgctggaggtccactccagaccctgtttgcctgggcatcaccagtgaaatattgttgcctgatccttcctctggaagctttgtcccagaggggcacctgcctgtatgaggtgtctgtcggcccctactgggaggtgtctcccagttaggccacacggggctctggcacccacttaaggaggcagtttgtccattctcagagctcaaatgccgtgctgggtgaaccactgctctcttcagagctgtcagacagggctctaacttcttgataaaggtgttttaaggctattaagtttcttcttaacactgctttggctgtatcccagagattttggtaaattgtgtctctactctcattagtttcaaataatttttacatttctattttaatttcaatgttcacccaggagttatttaggagtcagttgtttaatttccatgtattgtgtaatttggagcggttttgttggtattgcttttcatttttattgcactgtggtccaagagtgtacttggtatatgatttcagttgttttttatttattgaggcttgctttatgaccaagcatgtgttttttttttttttttggaatgtgttctgtatgcagatgagaagatgtatattctgtggtcgttgggtggagtgttctgtagatgtatattaggtctaattgctcaagtgttaagcttaattccagaatttctttgttaattttttgcctcaatgatctgtctaacactgtcagtggaatgttgaaatctcccactatttttgtatggttgtgtaaagtcttttcttaggccaagaagatattgttttataaatctgggtgctctagagttgggtgtgtatatatttaggatagccagagcttcttgtcagattgtaccctttatcattctgtaatacctttcattgtccttcttaacttttattggtttaaagtctgttttatttgatataagaatagtgactcctggtctttttaattttctgttattgataaatcctactccactcttttactttgataaattttttttagagatgggatctcactctgtcacccaggctggagtatagtggtatcatcattgctcactgcagccttgagctcctggattcaagagattatcctgcctcattctcccaagtagctgggactatcagtgtgcaccaccatgcccagctaattaaaaaacaaaacattattgtaagatatggggtctttctgtgttgcccaggcttgtctcaaacttgtcttcaagtgatcctcctgctttagcttcccaagtggctgagatcacaggtgcaaccctccatgcctggcttagtttaaaatgaattcacttcgtatcttaaattttctaatataaataaatgtacaatcataaatacatctgtattaggtattttcattgggtagtgttaaattgaaaacatcactataataaatatatttctaaaacttatctaggatttatttttctaccaaaagtataaataattggaaacaatctttgagtattattgtaaagcaatttgatcattgtgtggcagttttatatagtatttaagtagtaaagtcgggaaactttggaaattgttcatgctttcaggtgactagaatgccctagcttttataagtcagtagcatacctagtagttgagaccttagtataatatatgattaatagactttcctgaagctttttagcttccgagagactttacttcatctcatttttcatttctcagtaatattcatgagtgatatatattaggaattggtcattaattcattctttttttactgaagcactctaacatgagtttgaaaaaaacattgagctggcaatttctgctttcacattttattacagcctcaaaacttgttttataatgatttttagtgatattttaacatctttatgatttcatggcaccatacatttggaaattccattcctactcttctagctaccaaaaacttttccctccctcccctggcacacttctttcagcataggagatgaatgtaaccatagaattagggccccatacttgcattttttcattacttttgttctgttgaggtatcatgatagccacaaaaaacatctaggcctacaactaattaccttgcaaatggtaaatcactgtgggtttgaaattgtatgtaatatgaccattcttattacatagttaatcactaggtgtaagggcttttctattcattaatgttggaaataacagactgtgctgcccataagagactgagttggattatagagagaagagagtaaaatgtgcacgtttcatttgatggtatttttaatacgataggtgctatagatatagtgattttgaaaatgatctttcccatatgactattagtaagatttctttgttaatagaaaatgtatatttagaattttgttaagagtataagagctggactctgatggcttgggtttatatcctggccatttccaaagtgtaatttggcgaatatatttaatccctctgtaactcaggttcctcatttcacaatgggcatactaatagtacctatattatacaatattttagatggttattgggaggattaactgagtttcatgtaaagcagttaaaacagcatgtagtgcttggtaaagttagctgctattagctaatactgtgacacgtaaaattcaaattattaatgattcgggtgcctaaatgaaacttttttttccttagctcctttttcttcttctagaatcccgaagaatgtttaaatttaccttgaagctgctagagctcaagcttcagcccctaagcattttgtttttaatttttacttttcttcttgaagcggagtcccaaattatatgtatgtgctttaggcataaccaacttctctaaaaattaatgacttaaaataaccacttgttttgctcatgaatctgtaatttgggtagagcttggtggggaccacttgtctctgctgtatacagggttcttggggcagcccacctggggctggagtatccttttccaagatgtcttactcaagatggctggcaaattgatgctggctgttagttctccatgtgagccactctgtggggtgactttagcttcctcacagcatcatgactaggtgtcctgagcagtcattgagcaagtggtgcaagagaccagaagtggatgctgccagtttttaaagacttgggactgaaagccagcctgtctttgctagaagtaaatacagtattaagttctactatattttattgttcaagtggccatagaacccacgtttaagaagaggggataaacaacccaccttttaatggagaagtgtcaaaaaattttggttccatattataaaaccaccacactgcatttgctattaattaaaataataacaagcaaggtagctattatggactactttgttgaagtgtacccatttgacagaggatgtggtttctgggttactttaaaaaaggaaaaagccactttgacctcctgatgatgatatattcatacttttgttttacactggaatttcaactgaagcaccaacaaatatatcagatgtcaaaatgagttgtgagaaattatccaaacacaaaatttcaaagaatataacaaaatgagttatataacttttgaattctctcacttacattgagtgtataaaaaattcaagggtaaaatctgagagagaattttctgaggagaattttctgaggagaatttatattgggagaactgtgggggtgcatcccctgtccctctgcccctcatgtgtatctgtgcatcatcgtaagtgtggtgagaagggcttcaacaaaaccccttggagagtatgattttttgcttcaagacaatgacaaaagtcctgatctattactgagggaattaaggaggcctagggttgtaggatggagggcggagtctggataaactgtatcacctcccacagcagggcaaatggaagtgagccccagggctggctgtgaaacctgtggtaaagacgttagcctgaggtcattttaaagggatcctgcccagagggcagcctgtcaggggaaggggagcccaggagtacattgctatgggcatattgtcagaagccatattgtcagaagctgaaattgaaggagatctagattagtcagctgaaagagaagcagtcccgcatgttaggattgaagttgatgggtcctgcagtgagacctctgtagagacttaaaattccactacaatgattcagccaaggacatagagaacgaagccatcttatggcagtccagtcaaataagaacctttctaacctcttctcagttctgatcttattcaaccctcaccttgctctgtccttagtggggatgggaaaccagttggccagccgagtgaggaagaaaagtatcgacaggcaaaaagaaaagatggacaataactctttctccagctgtaagccaccagcttgcagcagtccctagttggggcagaagaagagttaatgttaaatttaagttagagctttgattattatgtggagtgtgccattaaatatttttattataaaagctttccaacatgcacaaaagtagaatagtaaaatgagcccctttttacctccgacttagaattagcaattatcaagattttgccatacttgtttcatgtatgtctacataatatagagtgcagctataaaatgtatggatattttcctacataactacagtgcttttatcctacctagcaaaactaacaataattccatagtattgttcagtaataagtccaccttcaaatttccttgattgtcttgaaaatgtctttttatagttaatttattctaattaaaatataactaagttgtagatagtttatctgacagtagtcttcttggcatctcctacccaccaaccaacagtgatttgttgaagaaatgtggcaatttgtcccatagaatgtccatgttctgaatttgtttgttctcttttttggattacttcacatgtttctttagcccccatttttcctgtaaactggaagttagctctaaagccccaattagatttaggttctgctttttgggcaagaatgctacatcggtatggtgctgtgaatttcatattgcatcacatcaggaggcacaccgtgtctggctctatcactttagtgacattgggattcagcagtgggttcaggtggtgacagctcagtcctttcattgttaagtttcccattatctttgtatctaattgtttcatccatgcatgctggcttccttgattattttactaggagttacaaataggtgcttttctaactctgtcattcttacctcattagctggaatttttctgtaaggaaaaactttttccttaacaacttggctatttggttacctggaaaaggagtttacctaggatagacaggataaatgtttaattctttccctttaaatattaatttcagagtaagtagtttgtgccctagttaccttcagtggtggccattgaactgactttctttccatctttcttttcatccctatgaacatatggatttatatattccacgtgtttcaaacaatcacattcattatccctttagatactcaaaaattttaatctttagccaatgggaacgctttcatgtttctcttgtgacgtgaccccattactcttacctggtttccttgctcaagatgttcaggtttattttgcatatttctttccccagataccagtcattcctctaaaaagtgctgcttccttgtagtggggaatgatggttagaggcaaaagtctgggcccttatgatccttattgttattgagttgtcattacttggaagtctttttagtggacagagccaggaaatatgtattttttacaaagaaaaaagtcatgacgtgatactgatatttccagtttaaatttaaccttacagaaactttacatgatttctttgatgattttattgtcatttctcttttctgtgtcttttttttttttttttttttaaatggagtcttgccctgtcatccaggctggagtgcagtggtgcaatcttcgctcactgcaacctctgcctcccaggttcaagctattcctcctgcttcagcttcctgagaagctgatactacaggtgcgcgccaccatgcccagctaattttttgtatttttagtagagatgaggtttcaccatgttggccaggctggacttaaaactcctgacctcaagtgatcctcccgcctcagccttccaaagtgctgggattacaggcatgagccactgtgcccagcgtgttttctcttaagtaattattatttgctctatcctacaaaatgtatagtttcaaaatatatatctacagtatataaaacgtggtttcaaaatgtatattctatagcataaacatttaatttcacataattatactgatattaccactgagaatatttaatgaaatataagctttctttacagctgtatttgtccttagaatttattctactaggtatagacagtgaaaatactgtattctatagccactagaaaaatttatgtctgtgctattatcactactttatattcagttgctttatttcagttatttgccagtatatatgcatttacttataaaagaaacgttggtgacttaaaacctagtagaaatgattatctatagagggaggaaaagaatgggtaaatggaagtgagcattctctgaatatactttcttatataggtttaactttggattcatataaatgtgttatatatttagaaagtaaaaatgagattaaaaaatcttcacctggagatgccaaatagtctcatggagataatgagtttggaatttaggggaagttaggaaatttttggaagttaggctggagatgtaaatttgggagacggtattttaaattacaggtgagtgaatgagaccagagtgagtctgaatgtggatgaagcagtctgagcctgagaagtgatacgtcccatgacgtagaggtcagaaagaaggcaagggttcagcaaaggaggcagaggggcttctagtgaggtgagaaggaaaaccagaggagtgtggtgtcaggaagccacaggaaaacgtgactcaagaaggaagaactgaccatgtgccctcccactcactttttgtattgctatcctttcgtatgttctaaaccacaaatgaatatctaaagagtcataagaagtagctgaagttagggaagcgggggatatttagagtgggagggtacaactctgataatgggaaagtgagtccaagtgagaagttgaagtaaaccaattcattgaaaactttaactcggagcctaactgcctccttataacctcagaattctcagctgattttgcaacttagatggaaatcaggaattaaaagagcatcaaactaaaattttcagtcagaataataagaagctaaaagtattgtctttcaagaaacacaaagagaaaaataaagatatcttctatttttttaaaggcaattgattagcctaaattttttgattgaaggaaaagacaattatcatgatagaaagtgagggtggagtgggtggtataacttcaaagtgttctgcacgctggacacattgatcaaaggcaaaataataaaagagggaagtctgaggagtcattacattattacaaaaagactccccgtatttcagtttatgacaccagagttcctaagttgaagtcaagagatgaaagataccatagttgatgcactcaatgaattctgttaatggcttccttttcacttgtgaattttcttcaaaggtaagttttaggtacaaaggatttcacagaaggatgtgaaatacatgcatgtggagggaaactggcttctctcctcaagcaatgtattatggctgagaaagaaagtgtggaatggaagaaaagtggggaatggtaaaaatacaatagatgatctgttttttgtttcaatgtctatatgcttgtgttgattaagtgatatttttgccttttttattttataaaaacatttgacatgtatgaaacatgttaaggagttccctgtttgcttatgggtggagaagacattaatctaattctaactataaggttgtaattaagccctgggtgtttatacccacaattcaagtgctagattctgggtgttaaatgatcttagttttaaggttttggttcagagttctaatttctggaattttgcttttcaaaaacagcatcagaaatgaccaaaagtaaaatatattcaatgtagaaactatggaaaacatagaaaagcacaaagaaacaccaaaattactgaaaaactctgtacctaaaggttgaccactgttcttccagtgcttttctatggatatactcacttatatacataaatatatttgtacatttttttctattttaatgtaaaatattccattttagattaacatgctgcatcatgaaactcatttaaaatataccttgatattttatgatatgacttcccttattattttaaataattataagaattaaaatgacacgttttgttgtatttcatttgaggaattcatgtgtattcaaacagcaggatcagaaacagagatattttgttatctattgctatgtaagaagccatgtccaaacttagtggcttaaattaatttacgatgatttctcacaggtctagggtttgaaggacttagctgggctcttcttccttggggtgcatcatagttgcagctcgataacggctgaggctgatgtcatcttactgcttaatcattcatgtatctgatgtctgagttgtgatgtcatatctggacatgacatgtatggatggctggaggctaactagatatgtctctttccatatagccattccatgtggctagcttaggcttcctgaaagcatggcagtcttaggtagtcagatcccttatactgtggtgccttcctctggggcaggcattccaagaggactgggcagaaacttcaaaacaacttaatgacgtagcttcagaagaccaagaatgtcacatttctactccattcttttggtttagcaagtcaccaaagcccagattcaaggggagaggacttagactccattctcaaagtgaggagcactaaagaatttgcagctacctgtaatctattaaaagtggccccatccaatttgaaagtataataatacactgttattttaatgttctgtaacaacagacatatctgtcatgttatatattcatttaaatactattactggaaaaatggcacttgtgtgtttttttaaataaaaatgctgtaatagtatttttgtattgtatttatcctacttgttacccttgaacacttcccagtgtctgtagttttcataatttttttaatttttaatttttgtggttacatagtaggtgtataatttatgggttacatgagattttttgattcaggcttgtaatgcataataatcacatcagggtaaatggggtatcatcacctcaagcatttatcctttgtcataaaatatttttaatgaggctgagcatgatggctcatgcctgtaatcccagcactttgggaggccaaggtgggtggatcacttgaggccaggagttcgagactagcctgagcaacgtggtgaaatcccgtccttactaaaaatacaaaaaattagtcaggcctggttacaagccatacttgtaatcccagctacttgggaggctgaggcatgagaactgcttgaacctgggaggcagaggttgcagtgagctgagatcacaccactgcactccagcctgggcaacacagcaagactctgtctcaaaaaaaatatatatatatattcatatttttctgatatatcacttctgaaattatgtaaatattatctactggttagataaaatagttactataataatgacaaaataattgttcactttaaattgtaggggggttaagcaaaccagtatacattataaacagctaaaataactagagatttgctaaaggaaaggcataattgctaatggctcaatgcttaactgaccactagggaattgtaaatgattgaaaaagtcaactaatccgggacacttaaagtgaattattgtgttagtagctaaaaatactttgaacctgaagtcccacttgttgaaacattcttttagtagctatggttttgttcatgtaaattgggtgaattaataagaattaataagaataacacaagttattgaatggttaacataacttaggcattgcgctaagtatattacatacattatttcagtgaatcctcacaactactctttgaggtgggtgatttaatttcacattttcagatgagaaaacaggtttagagacacaactgagatttagagatgctaagccacttgccaagctaactcagataataaggagtgattcaggatgtaacttaggtgatgtaaactcaaaacaaatgtttggactatggaaaacagtgtggagattccttaaaagtagatctgccatttgatccagcagtcccactcctgggtatcaacccagaggaaaagaagtcattatatgaaaaagatacttgcacatgcgtgtttatagcagcacaattcgcaattgcaaaaatatggaactagcccaaatgcccatcaatcaatgagtggataaagaaaatgtggtatatatgttccatggaggactcagccataaaaaggaatgaaataatggcatttgcagcaacctggatggaattggagaccattattctaagagaagtaactcaggaatggaaaaccaaacattgtatgttctcattcataagtgggagctaagctatgaggacgaaaaggcataagaatgatacaatggattttggaaagggtggtaggagggtgagggataaaagactacacgttgggtttaattagatcccatttgtctattttggcttttgttgccatttgttgcttttggtgttttagacatgaagtctttgcccatgcctgtgtcctgaatggtattgtctaggttttcttctaggaaggaacttctgcacagcaaaagaaactaccagagtgaacaggcaacctatggaatgggagaaaatttttgcaatctacccatctgacaaagggctaatatccagaatctacaaataacttaaacaaattcacaaggaaaaaacaaacaaccccatcaaaaagtgggcgaaggatatgaacaggcactcctcaaaagaagacatttatgcagccaacagacacatgaaaaaatgctcatcatcactggtcatcagagaaatgcaaatcaaaaccagaatgagataccatctcatgccagttagaatggcgatcattaaaaagtcaggaaacaacaggtactggagagggtgtggagaaataggaatggttttacaagtttgatgggagtgtaaattagctcaaccattgtggaacacagtgtggtgattcctcaaggacctagaactagaaataccatttgacccagcaatcctgttacttggtttatacccaaaggattataaaaaatcatgctactataaagacacatgcacatgtatgtttattgcggcactgttcacaatagcaaagacttggaaccaacccaaatgtccatcaatgatagactggattaagaaaatgtggcacatatacgccatggaatattatgcagccataaaaaaggatgagttcatgtgctttgcagggacatggatgaaactggaagccatcattctgaacaaactatcacaaggacggaaaaccaaacaccacatgttctcactcataggtgggaatcgaacaatgagaacacatggacacagggcggggaacatcacacatcagggcctgccgtggggtgggggctgggggagggatagcactgggagaaatacctaatataaacgacgagttgatgggtgcagcagaccaacatggcacatgtatacctatgtaacaaacctgcgcattgtgcacatgtaccctagaacttaaagtataataataattttttaaaaagagtacacattgggtacagtgtacgctgcttgggtgaggggtgtatcaaaatcttagaaatcccaccaaaagaacttactcatgtaaccaaataccacctgttctcccgaaacccattgaaataaaaaaaatatgtagtattcaaagaaaaaaaatcttttatcattaactatgatcttggtaggagtttttttttggtacaagctttttatcaaattagcaaattctcttgtattccaagcatgctaagaattttatgttttttacataactttcttgatatgtaattaaattaaaataaacttcttatgtttaaattgtacaatttgatccactaccacagatgtatacatctgcaaaaacattactacaataaaaatagtgaacatttttataatccacccctcaagcaaacacaagtgtttgtaagtctgtgtaatacgatttcttcttgaaataaaaaagtatagattggtaatttggaatatgattaggtttagggtagaagaggatgcaaaggtaaataaaatatgacacactttgttatggtgtggctgtgtccccatccaaatctcatcttgacctgtagatctcgtaatccccacatgtcatgggaggtaccaggtgagaggtaattgaatcatgggggcagttacctccatgctgttctcatgatagtgagtgagttcttgtgagttgtgatagttttataaggggttcttcccccttcgctcagcacttctctctcctgggacatgtttgctgcttcttctgccataattgtaagtttcctgaggcctccccagccattcagaaccatgtgtcaattaaacatctttcctttataaattactcagtctctggcagttctttttttttttttttttttttaatcattcttgggtgtttctcacagagggggatttggcagggtcataggacaatagtggagggaaggtcagcagataaacaagtgaacaaaggtctctggttttcctaggcagaggaccctgcggccttccacagcgtttgtgtccctgggtacttgagattagggagtggtgatgactcttaatgagcatgctgccttcaagcatcagtttaacaaagcacatcttgcactgcccttaatccatttaactctgagtggacacagcacatgtttcagagagcacagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcccagacggggcggctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcctggacggggcggctggccgggcggggggctgaccccccaacctccctcccagatggggcggctggccgggcggggggctgacccccccacctccctcccggacggggcggctggccgggcggggaactgacccccccacctccctcccggacggggcggctggccaggcagaggggctcctcacttcccagtaggggcggccgggcagaggcgcccctcacctcccggacggggtggctggccgggcgggaggctgacccccccacctccctcccggacggggcagctggccgggtgggcggctgacgcccccacctccctcccggacggggcggctggcctggcggggggctgaccccccccacctccctcccggatggggtggctgccgggcggagacgctcctcacttcccagacggggtggctgccgggcggagaggctcctcacttttcagacggggcggctgccgggcggagaggctcctcacttctcatacggggtggctgccgggcggagggtctcctcacttctcagacggggcggccgggcagagacgctcctcaactcccagatggggtggcggccgggcagaggcgctcctcacatcccagacagggcggcggggcagaggcgctccccacatcccagacgatgggcggccgggcagagacgctcctcacttcctagatgtgatggcggccgggaagaggcgctcctcacttcccagataggatggccgccgggcagagacgctcctcactttccagactgggcaaccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatccccgcacctcgggaggcagaggctggcggatcactcgtggttaggagctggagaccagcccggccaacacagcgaaaccccgtctccaccaaaaaaatacgaaaaccagtcaggcgtggcggcgcgcgcctgcaattgcaggcactccgcaggctgaggcaggagaatcaggcagggcggttgcagtgagccgagatggcagcagtacagtccagcttccgctcggcatcagagggtgaccgtggaaagagagggagagggagaccatggggagagggcgagggcgagggagagggcgagggagagggagagcgagagggagagggagagtgagagctctggcagttctttatagcaatatgagaacagactaaacacacttcttaaaacaaaaacaaaaagagtggtgggtggtctttttagttataagacaaagaataatattacaggtgatttataagagagatatgatcaactcatcttcactatgtggacacaggacagaggcagagggtagttgggaggttacacttagttttggtttgatacatgtttgagggactggtaggacatttgtttggagatgtgtagaagtcagttgaaagtgtgagcaggattggggatttatttctttaacaagaattattgccactataatcaaaagtttgccagaaacttcgaggtagctcagtggaagtgttttgatagctgacaatatgagtgttgttctgcaggatgtaaatatcaatggggaaagttgttctgtggccattatagattttggaaatattgaataaaagttgtattcttttaggcctacttagggtttgttatagactttagtaagtattttgaatatttaagaaggttatttagtatctgcacaaatgtatttcctaaatgtatttctaacagaattctttcatctgatcaaaatgtgggcataacattgcatagaccacactggggaatattggttggaacttaaatgaaaggataagagttgcactgggagacttttacagggaccaggcaaagctgagattgctcagaggacagggttaaatctgatattgaagggaaggagggagttgaagtggaagcttgaagaggaaaccaggctgagaatgggaagttgtttgtaggtaagaagagtgcattcgtgggatgaggagcaaaggagagagagaaagagggagagagaagagaagagaggaagaagagaagaggaagataaattaagaggtaaaatcttaaacatgaaagaatgaggtcagaagcatagatggtgggttattcttagagaagagtatgcatgttccatttttggagacagtctatggagatagagatggataattttgagggaagggaaataaaatcttttaaatgtttgaactattacaaaagtttaagggtggacagttaatattgatggggaatctgatgcaataatgaaagcaaataagaataaacattcttattttaaatgtatgaagatatactattcattttcagtaactattcacgcggtagtgtggagggcgtagttgggaggcaagaatagatttaaaaaggatttactttttcttaggaaaaaactcactggagatggaatcctatttaaatgccttgattttcgtcatgtttactgcggtatacccacgccttcaattatgcctggcagatagtagagactcagtgagtactttttgaatgccattgaatgatgaatgaatgttagacacagccacagcacatcaatagtgcccacatgccacacatggctttcctttaagctctttcaaacttgtgtccatgaacgaaaagactaagctcttgaaaagacttggcgctaagccctgtagccagggagagctgcttagggaccctgtgggctaaagatagcactaaagaaatggcataggcagtggagcgtttctcctctgaagaaagcacatacagagtacgtgctgacccgtgccaggagttggggctagcgaggcacatgggacacagcctgaagtagcaggcctggacagatggaggaagactggcttaagacagggcatcaggtaccggagctcagtggcagctgaagtactgtagtctgggagacaccagacctcctttaggaatgcattagccactggaattcttagagcatacaagtaggggagctccaagaggtaaaaatggatttcctgccagtgtgatgcatggcgtcttgagtaggatttaatttaatttggaaaataacggagtgctgacacatttgcaccatgggtgttgtggactagttcatacttgttacatgctagggataccaaggaattaataatcttcgttacatcacagctataagacaattttaatcaaatctatcaatctaaccctattatccctccaatcccagcagagtactgaaacacagtttgggctgcatttaaaacaaaaaaacccaccaaatcctttaagaatgagaaaagaagagaaacatttaattttggaatatgtgtaggtagtagctcatggccataaaaaacccccaaagagtagaggcttaaggtaagaaaagaaattagatggttagagtaaatgcattgagaaaaacacaggtgtacttacaaagtatgttcgtgaaagccaaaaaagtaaagccaatatagtattaggcattcacttctctgcaaagatgaatttaaatcaaacctaatgaataccttatttaaaattttaaataaaaaattttacaaaatgttttatacagctctcacccatctaaatgatcagttattgataaactcttaggcattccctaaactagaaaattttcatcccttgacatggaatttttaaatgttctgatagctgttattaacatttttatcactaaatacatcagtctgaaatgagtttaccctggagttagtgttacttctagagggtacttaacaatcttcaatggatttagcaaagagtattttcacatttggtttttacctgattgataaatgcttttgtaatcttatcaagcattatagaaagtcattaaaaattgatcttaggctttatcatctttttttttatttataaacttctgtgtaactaagaagccagagaagcccaatctcagagatttttccttagagatataagcatatcgacaaaacatcgtagcataccgagatgacatgaaatctcacaagttcaatgtgtatgaggcggatggagaaataatactgtaaagtcattggcttcaaacttcctgggatggaaatgtttgtaatccaggcttaggttttacaagtttcaaattgatggaggattgtagaagttgggggaataatagagcatgttcaggtattttggttgcaaattaaggctcttattttaatataattttgtacagtccttgaggccctgtggaaaattgttaattgaagggattgaatgtctaaaaaatattaaatatcttgttttagtttggtaaatggctcctggtagtgacaatagataatatgacacgcaaataccttgcaaatgggaaagaggtagtacttagttggaccataagtgatcttccggagctctgcctaattcatttgagcatcacatatatattttttattattatactttaagttctagggtacatgtgcacaacgtgtaggtttgttacctaggtatacatatgccatgttggtttgctgcacccattaactcgtcatttacattaggtatttctcctaatgctatccctcccccttccccccacctcacaacaggccttggggtgtgatattccccaccctgtgtccagttgttctcattgttcagttcctacctatgagtgagaacatgcagtgtttggttttctgtccttgtgatagtttgctgggaatgatggtttccagcttcatccgtgtccctgcaaaggacatgaactcatcattttttatggctgcatactattccatggtgtatatgtgccacattgtcttaatccagtctatcattgatggacatttgggttggttccaagtttttgctattgtgaatagtgcagcaataaacgtacatgtgcatgtgtctttatagtggcacgatttataatcctttgggtatatacccagtaatgggatggctgggtcaaatggtagttctagttctagatccttgaggaattgccacatatttagccagaataataaaatgtttatttttcttcatatcattggtaaattcacacaattccattttgtgtcaaaagtaataaatgaaagtgagaaccagaaaacagcacattgtgaacaaaattaaataaagacctacttctttttaaaaacaaaaattaaaaaaaagatgcattaaaaaaacattcaaaatatcctttcacttagaagcaagggaaaacccggccgagcgcagtggctcacgcctgtaattccagcactttgggaggccgaggcgggtggatcacccgaggtcgggagttcaagaccagcctgaccaacatggagtaatttcgtctctactaaaaaatacaataattagccgggcgtggtggtgcatgcctgtaatcccagctactcaggaatctgaggcaggagaatcacttgaacctggcggtggaggttgcagtgagccaagatcacgccgttgcactccagcctgggcaacaagagtgaaactccatctcaaaaaaaaaaaagcagcaagggaaaacgaattcttgtaaataagccttgtgttaaataggaactcatatctgtggcaataggctttttagaatttcataatataacagactttttagaatatcataccactaggaactccacttaccaaacctgagatgcagccaaaactatacatgaagcaaaaccgtatcttttaaataataaaaagtaacttggttttcaatttatgaatcttaaaagaataccgtactaaaccaatcaggatagagaattgataaagattaaaaatgaaattgatgaattagaaaacagaaaaacattggacttaatcccagatcaaaataaccaaataaagtcagtagtcttataacttcattttacagaagaggaagtagactcagacgttaacaatagactcaaacattaacagcctgctcatagttgccctgctggtaagtatcagagtactctaagggcatagatgctaggctctgctgcatttttttcagtgtgaagattggaattatccaactggccaattagtctaaattctgggtaacagtttatagctttaatggctagaaagtggtttgcaagtgatactgctggaggctataattgcttgaggaagccaaggaaatatagtaaaaaccagcagtcatttggggattgctggaggcttggacaataagggtatacaggcatcactacagcctggaacattatgatcaagagccttattaacagaagaaataatgaacgtagacacatgatttcagagaatatttgaagaggaaaatctgaaattgttaattagccttttggcaacacatctccataaatgtatgctgtaatgatcctgtattccattaattcttttagactcccgtatgtgtatcctattcatcatccaattagattccattcccaaattctgcagatttacaatacaacatcctgacaatgtttcgatgcctggtacagtttttaatatgtcggtagatagatggaaggaagtaagtttgtttgatttaacggaaaacagtaagaaattttcgaaaggggagaggggtgctatacataatgacttccttccaaagtagttggtatggaaaagagggcaagagtaactttgcagtggagcaccctgacaaataccacctcggccaggtaaccaagctcgacaccaatagtgataagtcatgttgatagtatgtaccttttgtataagtgatgagaaagtctttttgcctttttggtcttccccaaaacccataaccccagtctaatcatgagaaagttatcagacaaatcccagctgagggacatgctacagaatacctgaccacattcctcaaaagcgccaaagtcatcaaaaataagaaaactctgaggaaatgtcacagccaaaaggagcccaaggaaacatgacaacccaatgtaatgtggtgtcctggatgtgatcctggaacagaaaaagaaaattagctaaaaacgaagaaaactggaataaagtgttgactttaattagtcaaattgtattatgctttgtatttctgttgtgttttagaaatgattaatagacatggtggtggctcagcagaagctgggtggttaaaagatttgtggtgtttaagcctgaagaaagactgggcacatgcaaagtggtgtggcagtggtttccatttcaaaacactttcagggcctcttgatctaacttttggtttctatcatttctttttcctttttattttctaaacctggaggaaccacaaattattacagatgaaatacaaacttttttttctaaccatgaaaagtactgttctccttctctgagatcatacatgtagctgggagggtaggcatctgccaagttcccagacctctacctgtgcttcccatgccagttgcagtgtgtagaggtggcggatactgtggttcaaattttgggggtcatccagaacatcagaagccccaacattttgttctttcacatacagtgttgtaattcatttctcttctgaccttgaagtccatgatgagttttcattgttcttttaaactttcctaagttctcaatgtttccatctacttcaaacattccttcactctaatgttgctactgtggagggtaggcaggagcttgtggatgtatgggtggtgctcatataagacagtccaggatgcccaatgctgtttcctttggtctcttgaccatgtggagattgaaggtctacagcctagaaactggcacttcatggtgcacagagatggattccctcccctgggcctcatgactacctcagtgctgtagcttttcattttgcttccctttagcaattgaggaaactcaaggccatgtgaagggaagtgacttgtctaaacttctacagctgggaagatggcagagactagattggagcccaaagctgagtggaatcaatgcttgcctcctgctttggaggtgacttggggcccaacaccccaggaggcacttgcagtgtccagctaaaggtttcatggcatctgtgttaggatgcccatggaggtactgccaggaattcttcccattgtcctatgaaatcaaagtcctgggacactgcatggaggcattccacaaggtggtgagcgtgcatgtgtgtgtacgtgcctgcacacacgtgtgtgcaggcacgtacacacacatgcacgctcaccaccttgtgaactggttttccgcctctgaatgacatggagataagaaatttcttactttcctctttgaccctagtctgaggagacattaggagggtataggagagcaaattctctgtctaactggcagctactgcttagctccaggcaagggatgccatggagaaatgtggacccagatttgccaattctggtaatttttcaaaataatctagacatccatttttttaaaatgtgaaatctacaaattttaaatcttggcaaaaatgatcttttagtattgttttgtaatcacagtttggactaaaaaacacatatctctaggcatctgggtttgtaacattaaattccctcttttgctttctttcttactggcagtgagtgcaaataattcatttagaaagcataagcacctagattcttcaataaaaacagactgtcttcaatgaagagaaagaaactcacagaaagtatccaaagaaacaatttttaaaaattagataatactactgaatttcaggagaaaaaaaaaattttgtttgactagagctaattaaagttgttttcagtgagatcttaatttcaagaaaactgcttttcatgactttttaagatctatgtaggattacaaaattacgtttgtttgagaagagttacaggggtcaaaaatctatccttagatccttaagaccgcttcataatatgtgaaattgttgctgttgattttttttttagacagacgggtgccatctaatggtggtttaagaaatcttagttaaacatgtgatccttattttttaaaggacctaaaagacaagagttatcttactacttgacagagacactgtcacatactcagatttataacctatatgagcaaactttgacttattttattgcttctaaattggcctcaaaggatttagattagtgagattttcattttgtgctttgcaaatgtgggagagagaaagcacaattgaaacccataatcttctagagctccacagagctctggaattaaagcttctctacactgttcttcctgtttccatggtgggcatatgtagtccaaatataaacagctcgaatggcttttgtgatctgttttttgatgactcatgcaaacgggagtacatgagctcatggaaaatgtcaagcttaaatattctagaaagaagatagaaatcagaagttcagttacatgagttaaaagactttatgtaaccccaacactctgggaggccgaggcaggcggatcatgaggtcaagagattgagaccatcctggccaacatggtgaaacctcgtctctaataaaaatagaaaaattagctgggcgtggtggcacgtgcctgtagtcccagctactcaggaggctgaggcaggagaatcgcttgaacccgggaggtggaggttgcagtgagccaagatcgcgccactgcactccagcctggtgatagagcgagactacgtcttaaaaaaaaaaaaaaaagataaaaaaatagaaaaaactttgtgtattagatcagatatttacttgccctgtttctgttatgtaaaatgttacttttcctggaagtatttgtctgtactgcattattgttcatggaaatggccattgtagaatcagtcttagtatgtaccatggcaatttgtgatatcatggttacttttctggaaaaaattattgtgtgtaggtacattttttgaaagtttacaagcgtaactctcacacaaatataaaatgaacatgtcaagattttattcaacccattagttagtgaggaaactaatagagtgttaatactggtgcaaaaagcatttttggaacaaaatatttacaagaaaattaataaagaaatgataaggtaaggtttctgggtgagatgtaaaactggttaacatcctaccgggaaataaagctgtaacttatggattatatgtttcactgtacaaaaattacttgcacttttcagccaagtaaaaggatgatgaaaaaaaaagaaaaagaaagtacttgcacttttataggacaaatttttcccaatttacatgtgacttcactaagtctgagatcttttatcaatggtaaacaattgttgatttaactaagtgtgttttattgagtggtctgtgccttgtatgatcattaaaagcatagtccacacactactttttggcttgtattcaagcttgggatacctttttcttaaaaaataatcagacgttagcctcatgtctgtgcctatgccattgtcagagtaaaataactgtgtttgtctgaatctgacaaaactaaataaggcaagggaggatgaagagagtctcttgctttctttttctataccatgcttttcctaccttctcattactctaagatggtgggttaatctatttctttacttgttttttcattaaataagcatgtcttgagggtcattgtataccagggactgtactaggtggtggacaggtaaagctattcaagatgggcaagctcaatgtcctgcaggtgtttttgttctaaggagagaaacacaataaatgcaaatagcgacaactacaaagaaggaaacaaaagggcattgtttaaaagaggaatattaggcttccaggtagacattcgtgttgggaatttatttattgtctcagctacacaccataattattgtagaactcatcaataaaatggcagtttccattgactttcactacacctatccattcattctccagggaagggtagacacaattatggtaacttgcactttcctagaccacatgttgtgaaacgtacatcaatcaaaagtggttgccctctacacctagggggcagtagatatcctggtattcccctttatatcatcctgggatttcctttgatgctttgctgtgtttgactcttgattgctgatcctatattttcttctttcttagtttacttggtttattcccttgtttagatggagaactccctccagtaacatcttgagaaagggtatgtagagacaaaagttttaggtcttttatattaggaattatcatgatattatccttccacttaactaatagtttcattgggtatagaattttaactattaccttcagatagttacctttaatatagcactttacagaaaagggttttcaaacaattagagaaacctgcaaggacaaaaggaaggcgagaggaaacagttgcaactcagttttggagccagaaggcaaatggatgagtagtgattctcttagcagatccaagaaagcttagcagtaagctaggaggctgagaaatagccaaatttatacagaatagccactaaaggcacaggaaataatagtatcaggtacctttaaaactttggtggtgagtgagcaactaggtggggagaaaactgctgcaggagatccttaaaatcatcatcccttccatcctgtgctgctgctgaccccctgcttacccctccaaatctggtgttcattctccaggaaaggtaaaacaggatctcttgaatgatgatgtgagccgtgtttgtgggttaggatccctaaataaaacaggggattaagtgaccatatgatgatcgaattcagagactccagttttttacccccttctactaggtcccagatgtcctggtaattatatctgtaccctttaggtgggagaatggaagattcttctttggggaaactgatcaatgtaagagtaaagttttttctgtagatactaaaattgggactttctaataagtggttcactcgttcactgaaagttgacaagccacatccttctgcacatgctcagaactttcaagtattattttggtcacttatccttgatcatatgaagatatgaagatccatatattcagagcatcccagtcatcagtttagtctcataattttaagtatatatagatgatgaagaattaccagatatagaagacagattccagaataaataacaaattatttttgttaatttagaggtaacaaagaatacaaagagggaagattttttttaaaatcagtattttctaagatactttacaaaatcattggattaatggaaaaataacaggatactgttaaattcttagaaattgaaaacgatagcataaatttaaaaatagtaggataattgaaatttgatgatgaattaaattcttgggaagcagagcaaaaatcaaagaatcggtaattaagatataaggaataagatataaggaaatgagaaaactatcctcagaatatcagtgtgaaataataggagttctaggagagagatcagtgaaaatggagtgggggcagaaatcactgtgaaataataaaggaaactttgtccgtttgaaggttatgagtggcacattgaagggaatttacagagtgttcatccaaatggacaagaataaactaattccaagatgcatcattctgaagtttcagaacactttacaatgagaagaaccttccaaagggaggacaacacaaacaatcagaacgggtcacaaacactttagaatcaaaacaattttagattttttagtagcaacactaggagtttgaaaacaatggactgaggctctcaaaattctgaaagaaaattatttttacctacaattctatactcaattaaacctttagttaagtggaaggataatattgtgataatgcctaacatacaagacctaaaacatttatctttacataagctttctcaggctgtgactggagggtgttctccatcaaaacaagggaataaaccaaataaactactaaggaagaagaaaacatgggattaacaaacagaggatgaaacacaggaaaggattcaaagagattccaggatgatagaaacaaggatcccaggatgactgttgcccatcatgtgtagagggcaaccacttttgattgatgtaggtttgataatatgtggtctaggaaagtgcaagttaccataattgtgtcaactattccccaagagtgaattgatgggtgtagtgaaagtcaatggaaactggcattttattgatgagagatacaatgttgatggtatgtatctgagacaataaacatattcccaacaggaaagtctacatggaagtctggtattcctttgttaactaacatcttggaaaggtgtgctgatttctatagtctgtcttctgtaggaatacatatatttctgtatatatgtacacacataaacaatctcttgagagatataaatgaagttgataactgggattgactgtgggtaggagcagcatatggctggtggagggtactgtgagggaggcttattttttactgtttatctttttattccttttaaatattatgccacatgcatatataagttatttaaagatgaataaaataaaatgtatttcttataaattaaaaataaataaaaataaagacaaataacattaactacagtctgagtaagagactattcgttttatttattactttaaaaatgtttagcacttactctatttgtaacattagagtactttgcttttgaaagttgtaaatttaaattctgttttggtttgggagagggcaaagatcattttttttttggtggtgcttgccaaatacaaataagacagattaagaatgcttagaagctgaataattgatgataggaatgatgaagcttctcttgttccacaggagtaattctatagttttagaatgccccttagtagatgtaatagaattcaagtaattctaaacttgaaaaccttgttcctttaggatcatattttcagtattaattacctggtggtcacaccatgggaagatgcttgctatggcattgacaaggtaaaagatgaagctaataaggtcaatgcgttcattcaattctgcactagtaatgtttgtcttttcaggcccttgtcccatcactcatagatactgtacagttgtttattctgaaatgtaaagagatagagtcaactttcaaattgagggaaggttttatttttaatcgaagtcgattaatgcaaaattaattgaattatgactttctttcattgtcttctattgggtcctaattctcatttattttactctcttccttattctactccgtttctatatagttattgagacatagaaaaaaagactctttgactctttccttttaatcagaatatgctatacctattacatttcctaaggtgcccatcatttatttgagtcaagatgggaggaaggtactgtcctagataaacaggatttagaatttattgcttataatgacacgttgttgatgaattttataatatttgatgctcttatgggctacgtaatccaggtaaaaaataaagtagggaaaataggagtaggtttttaaacaggaacaataaagcatcgtgggaaacagcaataggaataaattaatgtcagactaatgtaaagaagcaagatattggggttccttggtgacaatcagaaggggcttagctttttcaggacactgagtcaatatggtacactcttgtcctgctgtgttctattctgaagacatccttagtttgtctaagtgtcttattagtcattaccagttttgaggtggaggggaaaatattagactgtgagtacagatggtggtaataattgcatgggaacagaagatagctagcgtggtgtcctttcatgaatccttagagaagaataatactgttgaatgttagagtgggacagaggggactttccactttgtttatcctaatatgagtttgcagtatcacaaactggagattggcggataaatattgatgttgaaagtgacggaaaacccaacccaagccagctagagcacaaaacgtaatttattgtctcagaaactgaaaactctaggataaagctggattcaagagcttaagcttgattatcaaaatgtggctcctttcatccccttggctctgtggctgtgtttgtttcatttccagactgtgggagaacttgccccaattatcacaatcccaaatacagtggtagagggaatttccattcttatgcttaaaggaaagtctcctaattgtgtcttctgtcttcttggctttgattgacctgatctgaatggccaaccctatgactctgtttaagccaaggaacatattttaagtatctttgtgttctcggtgattgatgagcacagggcgttgcatgatgtacaggtacacaatatacaaatgttatgttaaactgtaagctgcttttctgaaaacaaccattttacattgtaagagctggtctaatatagtccagattttaattctgaaatttttttggagcaaaattaggtgacttgttggagagactgaatatgattactagaattcaagaatttgagactttctgcctgtgtgctatcaggactctgtcagaacctcacagtagaattcaggaaataagcaagaaattaaattacatatcatcttagcatgctaagagatctattaagagataagggatatagtggaagaaagagttttaatttcttttgaatcatacaaaacaaaagtgagaggtgggagaagaacatggatgatagctggaaatgagaggatttgaatattggaatatcatcccattagagaagaggaatgatgtcagtgatgctaaaattattctttcacagttgcaacagaatacaaattacgcacatcatgatcttaaaacatatgtttgaaattcattttatagagaagtttaaaaataagtggtctgatggggcatgaaaaaattttgttaaatctagtaagagaaaaaaatgacctaaaatagatttaagacttatgtgctgtgtcaattactaatgccttgtcttctgagtttaatttaaaaaaagggaattccaaagactagatttttagtgtgatagaggaaagtgtacctagctactctaaaaaataaactattcagcatttgtgtaattatgcctgtcttctaatgggaacttcattttcaaagctttttttaatctttaaattctattgaatgccaactttgcccgaacaacttttcatacagtgtgaaaagatgaaagcaaaggagatgcaattatcaatgatgtcacagaatttgaggcatttccaatcatgcctgtgtgctcattttgcataatcaaaactcactgatggggaccaatttaaaatgaatttactgacttaaacacaggatcttggagctctaattgcctgggaaactgtaagaatgcagcatttgagctcattggtcctgacataaaaagatgctgttaaatatttaaagtagtcaagagagctgtagtgtcatttaaataaatgtaatgtttattagagtaataaagtgaaacttttaggagattcataattatgcaatcttatgagagttttggttattgtgcatgagcttgaaatatctgaatgcttggaaacgtagcataaatgatctatcatattattcaaggtggtgatgtgtgatttgttgaaataaaatgtaaatggcagtacagtgtggttattgggtagagagtttggagttagcctccaaagcctacatagccacttaactgaataatattgcatatgttgactaacccatctctgctttagttttctcagctataaaatggtactaatgctatgctcgccttcttcatagagatattgtaaggattaaatgtgttaatgtatataaagtaccttaaaacagtgcttatataagcatttgctgttatgatcactctgtaaaagtcattacggtttttcttccgaatgcacaaaatcttaaaatgcaatatcagaatatgaaaaaacatatgaggaagttcgcacatatagcattgaaaagttcagtagttaactcataactacaaatttggccttttgtatgttcactccaagacacacttctaacacgattcctcacactctaggacagtaattctcaaagtgaattataccaaggatgagttggatcagaattaatagggctacttgttaaatgcatattcctggtcctcactttagactcactgaatcagaatttttgagagtgagaattagcattttaacaaatgcctgaggtgatcctaatgcaggacagattttgagaactgttcttacttgttcatgattccctctactcatgctgtaatttcactttcactctgtctcacattgcacttcagatgtcttatttctctcagttcatggttctgtcacgtctcctgttcaaggactatagatttttctttcaaaatcacagtagattgtagttgatctttttctttcacattcaaagcctagtttactaccttctccctcttccattttgtgctctcttcattgtaccttgttcatttccttgccactatttgtcctaagtgggatgtgaaatcattctggctttagaattccataaaagaccttcacctggctttggtttagctcagaactgctccccctttcctgtctcacacatgctttgctttttcccttccatttctctcatctttttcatttcctttctttccatgaacattcctgggttggaagacagggaagagtttgcagctggtcaaggaaaactcttcttcagatttcattggtcttctggcaggtttgcctggagagaagggacaggtacaaaggaagtcccaatccttcagcatctctgtccctgttagcttatatccctttcctggactccatttgaactcggcatccctgtctggattttagagtcagaagtgtgtgagacatcattgagcagtctcagactgcattgtctgtatatacttaacggagaacattgcacttaaatcctaaaatatatcaggaactcatatatttggcgtgtctaagtataaagccatgtgtagccaagtggaaacaccacatacaagaaaattgtattacttcttggccaaggtaaagattaataggaagcattttggctcatagagtatgtaatgcagctctcctttaaaacacgtgaactttttatgttcgtgtgaatgatcacatagatccacgggaatcttaatgatccgtgagggaaattgttcacatttttagaggtatatctacattacaaaacagcagcactttcaggagaccactgcactgttgtgctttggaaagcacttgaatcccagagtgctgaaagtaggaacagtattgatgactcataaacacacatatcatagtgaaaaaaaaaaaaaaaaagaaagttgtcatggaaaaaaaggaaatatatactttggcaaatttaaagcaacatggacattttcttagacgtggtcttagtattttagctagtaaaatgaaagaaatttaagtcctggaaatttatcccttctttgaaaggattagaatttctttgcaataactaagaatttaaaaaattctcaaagaagacaagtttaaggaaaaagtagacaccaaccaagaaatcaatttattgctaaaaatttggcttcaactgtttcagttttggctggtatttcgtagttttatttgtgtaaatatgggctttaattaaatttccatgttgctgcttaggtttttcttaaaatgtggatgtcaataaattttttacatgaactaaatttaataagtaagtttaacttacagctattatcttggtatagaagctaaaaagcaaaaagtacttctgaatagtagaaagagaaccgtaagaatagaatcgtgtttttttaacttctgtcgtcacatatttgagtttgatggcttaatagtagatgtatttatgtcttagttgtttgctgtctaactcttcatactatgtttatatctatagacaatacaatctaatgagaatagattagatatattttgtgaataatatttttttctttttgttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcggtaagaaattattatagctctatttttactgaaatagatatgacgtttcttagttttaatggcaaggattttttttttctgtttgagattttgagcagtttcattatgataaatgatggataatttgcagataatgctattccatttttatctcttacaggtttatagagtgctccaacataatcatgtatatttaacagtactatttttaaagatatagactgatcattttgtagtgttcatatatttattttagaacaagaacttttcattttgggtaatttggattgtagctatctctgctcagatatactatctattgtaaggtggtgtagagaaaacgtatggaatatttaaaagtagagaaacgacaatagtaaaaaaaaactttagttatgtccaagagctcttttagtgggaaaaattaagtatattaacttaagtaaatgttgggtagaatttgttaaactattgatctatctagcacacaatttagttactgggtggattgtgtgtgcataagtatgtgtctatttttaaccagaaagttatgtcatgtgaccactaagagtattgctatatttgagtctcaaagtacttatactttttgtttgcaaaaataaaatcttaagaaataggcttaattatcacattgtgaaatattataaaaagagaagatgaagaaaaatgacctatgaacgaatccagtgctataattttagttatttgtgacatatatctatatatagaaattatttttagagtacacattatatgagataatctttttcataaaattttgattgaatcctaacaattttttcaggttcctttatcattttcacaacttttcttaatggtgttgtaattacttcctgatcattcttccttttcattgtggttgcttctaatttttacagttacgaatgttattctggtgaaactgtttacatatattttgatttttacctatttcgaattgttaaacgattttcataggctgaattactgtgcttttctgtttgtttcagtggctcttgataactctttcttaaagcttgtgtcattttctatagtaaggtatattttccaacacccttcacaacttacttggatttctcaagtatttaaaacttaatttattgttatgtatgagaactagaaattgactaaaatttccctatacatgatttttattggtactaaatcaaatattttttctagtagcttaattactcattttgagctctttcgtgaaagagatctcattttgatcgcacaagctcatgcagaatcttactaataatactgagaatcttaccagtaatgctgatttcacagaataagatcctaaaaagttaaggaaaagtttatgatgactaaaacatttgaaatgctaaaataattagatctttattggagatgtgggagaatataagtacaactttaggttgagtttgggaaagagcagtttctttgaaactgatagggaaataattgattttcctgacacagtttttggcaggccacatacatctctttcttttccttttctcttttttgttgatatataatagttgtacgtattttgggggtatatgtgatattttaatatttgtatacaatgtgtaatgatcaaattaggggaattggggaatatccccaatgatccccaatgatcaaattaggggaatatccctcacttcaaacattaatcttttctttgtgttggaagcattataattcctctcttctagctattttgatatatacaataaattaatgttaactataatttccctactgtactatcgaatactggaacccattccttctgtttttgtactccttaaccaacttatcttcattaacctcttcccttctcagcctctggtaaccaccattctactctctacctccatcaggtccacattctttagctggatgagaacatgtggatgagaacatgagatatctatctttcagcacctggcttatttcacttaacataatgacttcctgttacatccatgtttctacaaataaaaggatttcattctttttgatggctgaataatattctgttgtgtagctgtgcatatatacaacatttttttgagaattttagctataatttgtcttattgttaggtttgctgttgtctactccagatcaatcaagagcagagaaaaaaattcacataattgctttcctatataattctttttctatgtaatatttgttttcgtttcacagcatgaacaaatgattttgtttagaatcatttcttttttccttttttttttttgaggcagagtcttgcactgtcattcaggctggagtgtagtggtgcgatcttggctcactgcaacctccgcctcccgggttcaagcaattctcctgcctcagcctcccaagtagctgggactacagacacacaccaccacgcccagctaatttttgtatttttattagagatgaggtttcaccatattggccaggctggtcttgaactcctgacctcgtgatccgcccgtgtcggcctcccaaagtgctgggattacagtagtgagccactgcgcctggcctggaatcatttgtttatttctgaagataagttttttcagttgttaaatatttatgatttttgtttttgtacaccctatctataaacataaatgtcacttgatttatgctttttctcttgattgctgtaattaacatcagttttacttgtcctaatactgtgttaaataagaatgatctatattttgcatttgatagctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacaggtaagtccgtgtttcctccttataaaaattataaggaggacttataaaacttataaaaatcttttagtgcttaacaatctatctatctagagatgagccaattcagataactggtggtggtattcatagaatccagaactgacaacctcttcagcgcttccacaatctggttattccttgatcttgttcagaaactctgcaggtagtttttggatccattcagcttactcgggaattgccatgacagttgctccagaaaactttgccttccctttggcctttttttcttttattcctcccctgctaccaaatgtacaaagaatgactgtgacttctgagatcaaaggacaagaatacaaaaagcgggcatggaagtgggaggtccctgtgacttaaattcagagtaccgctgggagaaaaacctgaatagccttaggtttaattgaactttatggcttggtttattaggttgaggcaatgactcgctaacaccattctggttgttttttctaaagaacattaagaatttttttttgaataattgtgtcactaccattaaaatgtttgtgaaaattacacttgaaacagttatgttttgctcttttaaatcattctttaaaaaatatacttttgtgctgctgttgaatatcagtacaaatgttacagaaaactctccattttataaacagttttaatgttttatcttcagtttggttctgtgattcatagaataactaattctaaagttccagtaccttcaatagcataggaaaaattacattgaatagaattttgtactgtgtacttaattctgttatattagtgataacatagtaattataactaatttataatatagtattattagccagtgattatttataattatactatcatatattattaagagtcagtgactaatggttttcaaaacttttttgaaaatttttcatttggaacttcttaaccatattgatgtaattagaatgtttacttaatctgtgcattaagattacatatgtatttttattatattctgaataactacttgaagacaaattctacaaaaataaatttttaacttattattttatttttaattcattattttatttttgggattttattttagaaaccttcagcaaatgtgaagcttggatggccaaggactgttactgtgacaatattatcaaatgacaatgcatttggaattatttcatttaatatggtatggacacaatttgatgataattgtggttgctagataatagtttattaaattttaaaaattagttttcatgatgttagctagtatcatgctgtgttttgatatttaaataaaatttgctttaactttgtccctgtttcacattctgtagaccattcatttgttctacctaagatgtttgtgaattgaggacgcttgtatgatcgtggtcatcttttgtcctaatctctttctgctgattgttccacctgactcctttgttaactcttctgtctttaactcagatataccacccattgccttttcctgatttccccaaatgtcacctaaagaaagtgttgtttgtttgtcagactcttctgaaagtttggagttaatgggagatgagaaagcatattgaaagaatacttttctttttttttaattattattattatactttaagttttagggtacatgtgcacaacgtgcaggtttgttacatatgtatacatatgccatgctggtgtgctgcacccattaactcgtcatttagcattaggtatatctcctaatgctatccctcccccctccccctaccccacaacagacgccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtattgtgccacattttcttaatccagtctatcattgttggacatttgggttggttccaagtctttgctattgtgaatagtgccgcaataaaaatacgtgtgcatgtgtctttatagcagcatgatttataatcctttgggtatatacccagtaatgggatggctgggtcaaatgatatttctagttctagatctctgaggaatcgccacactgacttccacaatggttgaactagtttacagtcccaccaacagtgtaaaagtgttcctatttctccacatcctctccagcacctgttgtttcttgactttttaatgattgccattctaactggtgtgagatggtgtctcattgtggttttgatttgcatttctctgatggccagtgatgatgagcatttcttcatgtgttttttggctgcataaatgtctccttttgagaagtgtctgttcatatcctttgcccactttttgatggagtattttttttcttgtaaatttgtttgagttcattgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacaggtaagtctttaatctatcttgaattaatttttgtataaggtgtaaggaagggatccagtttcagctttccatatatggctagccagttactttcaaaaaacttactatgaacttaaattgaatagcaggtattacatctcttcaaaattctgtagtcatcccaactcttaggttttcccattaattaatattttctgaagattgaaacttcctttcatttcactcacctttgctcaatagtgtattttctgttccttaactgaattcctgtggctctggccaatcctgtgatcagagagttttatctttagaaacaaatacacaaaatagggcccttcttgagataaattgtttccagctcctaaaaccaagtttatctccaatacaactgaatctggtcgctaaattttagactccagtaacattcctgactcggagtctccttgaatcacattactaattataattaataaaacacgttgcaatacttcccagcttttcatttatttttagattgctactacaattggttgtattgtatgtcattttcttggtaccttaacttatctttgaaagaagtgggctataagtaaatatgatctttatagtgcagtatctttgttaaaaagggtatttggccaacctcagtttagtagaaattcggtaacctccattatactgtcatttacagacattaagttaattaatcaaccatctcttttatttgaatgataaggaattgaatgataaagaattgttaatgatgaagcaggctcccttaattgctaaatttctctccatgtggctttcctgctacacttactctctgtgtatcacctccgacctcatactgatttgtttaaaggtttcttttgttgttgttgacattatatatcttagcctatgggaatgaatcctagtttctgtcatgggtcctaggtccctgactggtgggggtctcagtgctgccaggcagcctctgacatccttaaaattaaactaaataaccattgagctcacggtggtgctcaataggctggctttgcttttcagccctgaggatgattatgttggtagtgaagatgacattgatgatgatgataataatagcaacatttactgtgccctcagtatatgtcaggtactaggataagcacttgatgtgaactatcgcattgaaacctcatcacaacccttcaagacggacattgctaaccccagttatgtatggggctactgagttttgctgtcaccctgagagctggcagctgcttctgtagcctgtatgtacttggctgtgtccgtgttcctcctcttctaccctgagtttccaccagctgaaccagcatatttcttttgaagtctttgctttcacctcctgcagagatcctgtcctgaaagttattagcagtgtctgcttttcactgacaagctggctgatgtggagaaagagtggttgtggacaaggccaagtggtggtcccagtgacctgctgccttggtctggaggcttaattcatgtttgtgacctcctgggcccctgtgagcatttgagtttgtcacctttcaactaaaaaacctttaaattcctcagcagaacagctagttgatggtagaaccaggacaagaaaccacatcttttgcctgactagtttttatgttccctttacactattctttttaactttttcagcattttaaagctatagttcattgatgctaggaaatatcacattcttatcgtacagtgtggattgatgtgtctgtggaaattgagcgtttctgaggtaatagtttttaccgcctcatacctctgattgctcagctcctgatcatctgtgcttgctttcctcaatagcttccctcaatcgcagtgagtgagcccaagggcagaaatgagtctatgcctcttactctcatcagggaaaagggaacctatggaatggtcatggtgacttttgaggtaagtttactctgaagtcattttattttatttatttttatttttatttatttatttttgagacagtcttgctctgttgcccaagctggagtgcagtggtgcgatctcagctcaatgcaacctctgcctcccaggttcaagtgattctcctgcctcagagtcccgagtagctaggattgcaggcatgtgccaccatgcctggctaatttttgtatttttagtagagacagggtgtcaccatgttggccaggctggtcttgaactcctggcctcaggtgatccgcccgccttggcgtcccaaagtgctggggttacaggcgtgagccactgcacccggccctgaaatcactttaaatgcgaacactggggttcataccagatggctgcaattttgaaaatcaaagttccttgtataataaacatgacacaatacaattaaaataaagatgaatacttttctgatctgatacatttcatgattaatataaaaatgttttccttgctgcttgtgtatacaatgcttacatgaaatacaagtaacattttagatatgtgggaaaaataaatcataggatagaataataatgttaattctataaaattcatggaacttttatgataaatgttttcaaagacaggaaattttaaaatacccatggattacttaggtttacataaaattatttaatatgttgtctttctctattttattttattttattttttttgagacaggatcttactctgatgcccaggctggagtacagtggcactatcatggctcactgcagcctcaacctcctgggctcatgcagtcctcctgtatcagcattctgaatagctgggagtacaggtgtgcatcaccatgcccagctaagttttaatgttttttgtagagatgaagtcgcattatgttgcccaggctggttttgaactcctgagcacaaatgatcctccctcttcagcctcccaaagagctgggattacagtcatgacccaccatgccttccccctgccccccatttttttcagtacaccaaatggatggtgtttgtagccattgcactccaccatgggaatccataaatgttacaggatgtggcatgaatatgataagctgtaggtgaggtgtatttttcaggggctagctctaatcattttatttgattgcttactgaccatgtgccaatcattgtgtcaccacattgctgttctatgagatacacatttaaatcttcaactaatttttgtgttttttaggatccacaacatgattatatactattttcaaacattagagtattagcaatttcagataccagtttctttcctaattattaattgtaatatcaataaaatggaagcatatttatttaacacaattctatggtagcatagaagagttctgttcatgcttgtgggtgtccacatcatatggtagttatgttaactacacagaacatagaatagcagaagacaataatgcatgaaaaacacagtaaacactaactaaatatgcagtagtcttgcaagttttacactggaagcattacacagtttttcaggtacttaggaatatgcatttagacaataaatttttgaaaatttttctgataaatattggaaaaattagaaaataattggctgtagaaaggataaatcatccagagtagagtgttttcaacttatctatggatgtctaaagttattttatcaggtttgtagcctgttttttgtttaaataattataagtaacatttttggagtgcttaatattgccatatactgttgtaagtgctttatattgattattactgcatacgtatagcacccctccctggcacttgatctctctcatgctattcttaattttttctctatgatacttattatcatctaacgcatacccattcatttatttatcatttattcccttcctttaaatgtcaggactatatggaggggaatttgctgtgttcactgctaaatctttagtacctaaaagagatgcagcatagagtactcaacaaatgcttttttaaatgaatgattttatttattcttcacatcttcacatccagcttgtgaagtggaaaatactggtattacttgagggaatttactaatcttgaataccctttcttccaagaagaaatatttgtagagttttttttttcccctcaggtttaacataatggttgagaaaaaacagctcgtagaaaccacgtagtttaatgcagttatagtcaatatctataattacgttataggacctattaatttgaagggcagaatgatgtatgggttagtgtaattcttgcagaacatctttaaacttcagatttttgtcagctgacatcacaatgatgctttctcagtcttgtgaagtattttgcatttattgatggcattttgtgtttctttgcaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcattttgtataccctggtaatcaatttttgttagtgctttcaattttgagcaagaacaatactaacctagaataaatattttaccataaaagcaaagaaaaattctactgcagttggtattcttttgtttttatttttttgttgttgtttagaaggagtctcgctctgttgcccaggctggagtgcagtggcgcgatctcggctcactgcaagctccgcctccagggttcacgccattctcctgcctcagcctcccgagtagctgggactacaggtgcctgccaccatgcccggctaattttttgtatttttaatagagacggggtttcaccgtgttagccaggatggtctcgatctcctgacctcgtgatccaccagcctcggcctcccaaagtgctgggattacaggcatgagccaccgcacccggcttgtttggatatttttaatgttcacatttatgggaagatttttattatttttatatttcacattggaactagcaaggatagagatacatgatacacctagcttaattgctaagaatgaatctgaacaataatgtgcaaggatgtcccccacatgagctaaacgagagaaaacatgactttttataaaagaaactaagttttgccagaaaagaaaacaaaaagaaaatagctggcaatttgtaaccctccctctaccctcctacaaaaattctgaaactaaatcacaagaaaactcaagagaagggaaaaaatgtattagagtattagaagacattattagaaaagaatttttctcttgaaaaaaaatgaaatatttggaagcattgatatctccagttcctctggttctggaagcaagcaaaaaaacctttttgttttaagatctcagagcattgaacgggctataatttggggagatgattaattatacattttgattgtaaatttgaaagatcaatcgaatcataacattttatttttaagataaatagctttgctttttatattgctgctgatggaggtaaaagcatgcatttttttcacttttatttctaaaatagagtttatggtgaatgaaaagctcacacagcacagtggagattaaccccaagatttctctgcagcagcataaataaaaggaaaaaaaaaagaaagaaaaaaatgaaaagcaaaaattgcactttaacagtgtcagcatttttcctagtagtgactcttacagctttttctccagagaggcatgatgtgtatcttgaaaagcatatattggtgtcacgtgtttaactcctgaattaacaaccatttggagaaaagcaagaataattcacaaggaaaactaacaatttttatgtaatgtttaacgtactttccagattcttaggtattattagactttcagtactacttctaagcatatcaaactgataaaactgatagaaatgtatgacagttttttactgtttaatctttggagttatctaaggaccagttaaggctgaaagacattatacctggacttcattacttgtactattgcttccttacgttttcttttcctgtgtaaaatacattatttacctgtggaaaatattttattaattggagactaaacaagcctttctatttgctccctcagttaaagaatttttatttctatgtaattgtattgaaacataatgacttgttacactttagtttatttgcaggtgttttggctgttgatgttttgcctctgtttatattcctttaacaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtatgatttattttaaatatattgctaccattattttattatattattccagatttaagttttgtggtgttggacacaacaatgaactgttagaatatgtgtcattttttcccacaaagtttcatgacaaactcagaaaagacacacacacacacacacacacacacacacacacacacacacacaagaatatgtcattttttctaccatggcttcactgttttctttcttatttggagtgtgatttaattatgcaaatgattcatagtatagtagttccctaggacacattcacatatctacaccttcatattaaaaatacttttttccgccaggcatggtgactcacacctgtaatcccagcactttggcaggcttgggggaggattttctgagtctaggtgttcaagaccagcctgggcaacaaagtgagaccccgcccacaaaataaaataaaataaaataaaataaaataaaataaaaagattagctgagtgtggtggtgtccacctgaagtcccagatacttgggaggctaatgcaggaggattgcctgagtccatgaagttgaagttgtagtgagctctgatcacaccactgcacttcagcttgggcaacagagtgtgacccagtctcaaacaaacaaaaataacaaatcagttatttttttgttgtatagattctgtttttatcagtgtctaatggacaacttgacattgggaaagcttatctaagggaaataaagtgtactatgtgacaatatgtatttcttttaaaacatttaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggaggtataacccttgttatgctttatgcttgttaatatttctgtgctgtacaagaaccaaagaatttggtcatacacatcaactttatgtttagtttgaagggacaggaaaaacactggctttgcaaatgatagttttcttactcagtattccttctgaaaataaatattttaccctctaaaaaattccacaaactgtgatttaggaatatttccaaatctgtttttggttcatcttttgctctattatgtataagaagtcatcatttttagacataaaatattaataaatattaaaattagaataacatggaaaatacagagtttgatcatctcagatgcgagaattctgtactttaatattttattcctttacttcagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacaggtacttgtatgattaaaataatcgtaattttggttaaccttcaagtgtactaacctgtgtgaaagaattaactgaacattattttgaccttgttattttgccgtcatttatatgttgttactaaaagttgtttaggtagtcggaagagagattatgcctgctcctaaggtatataagtataaataagacaagaatttttaccaaagttaatattttaattaagtgacattaaaagtacaccagacgtgaaatgccagtcatgcaagtcagactgtcatggatgacatagtagagtaacttacaaactattacaggggagggcgagagaaagagaggctaaccatgctttgaattgatttgggaaaatatgacataggaataggatttgtaggataagtatgttttcataatgaatattgcaaggaaaatatttcagaaacaaagcaatatgagatatatattttttctttttttttgagacagggtctcactctgtcacccaggctggagtgcagtggcggcatctcagttcactgcagcctccacgtcccaggttcaagtgattctcctgcctcagcctcccgagtagctgggattatagatgcctgtcaccacacctggctaatttttgtgtttttagtagagacggggttttcccatttttggccaggctggtcttaaactcctgacctcagatgatccatgcgcctgagcctcctaaagtgctgtgattacaggtgtaagccaccacgcctggcccaagaaaaattttataaatacttttaaataatatactcaaaaatcaatttctttgtctaggtagactctctggaccttcaactgtttagtaaagtccccatgacgtatccttccattttatacatttcatttcttctgttaaccaaaatattatttttatggccaaagtataaaatatctgcactcatttatgatactgttgttgttttccatgtgttgattgcttgatacttaaaattctaaatcaataaagggtacttattaaattatgtaaatcaattaaatacagaatcaggtagtgtgaatggactgacaaggaaagagctaaaatcttatgttgccatacattgtgccaactgaagtatatagcaaatgaaatattctatttcactaatttctttgaatcatgccacatttaaatatgtttcatattttgccttgattttgttttatgatggatttattattcctttctctggagtttctgattgtcccttttctgtatgttatcttcactatattattgagatcttgctgctgtcttcctgtgtgtgttgaatgttgagtttagctaaactaactgctttctgtgcttgtttcacatctgttgtctgggatttttttactgagctcctgaattttcttgatctgttgcgtttctcttttgggattatgctgtagttttgttgtagtatatctaccctcaaacaaatgtgctgaaagtatatatgtaaggtaaactttttgagtctttgagcacctgaaatgtgaaattttatactcatattgatagtttggcttggtagaaatttctggattaaaataatttattcttcagaacttgaaaggtattgttgttaagcttctagagttgcagatgagaaatttgaagggaaggaaatgatttatcttttagataactcgatctttgtctctgaaagctttttacaactgttccttggtgttctgaattttgtaagactgtgtcagcacttggtagggtgaccgttttcattttgaagactcccgcgtttttttaagctgagcctccaggcatacttgtgctgttagggcatttttcgaggactcttgtccaaggggcttagtgggtgacctgttacggggatgtaggatttgtcagtatgtacgcgacacctttttgtaatatacctacacagagggaggcatttgccatcttccccagagccctacactaatggcagtagatcctgatcttcatctttattattattaatttttgttttcttgcgtctcctccaagcgggaaaattttcatgtgatgcgagcttctgcctgtgaggataacttactctctggaggacccttggatttttcttggagtggaaagatagggaacacggctctattcacaattgtgtctggtttgtcctgtggcttgtggatgccagggagtctggatctgtgaagtgaaatactgcaaatggccacgcacatgacttgggcccttgtgagcattaagttaaaacaactagaatgctgctaccagaacacatttagagctatatttagaaactaaaaacaaaaacaaacaaaaaaatctctgactttatacaaaaacatgacataatttgtttgcttttaaaaattgattttattaatatggaagtgcatattgattttaccagttcacacttagagtagcatttctgaagtttcaagactgtgtgggattcaattttttgagtttcagaatttaatggaatttttttgacattagcacttgtttgtcttctctgctgtcagtgtcctcaggtttcagggtttcagaacattcccataagtatatgtttaagggctttttttgggatttttttggtcttactgttctcccttctgtttgtctccagtcttgcataatctacaactcatgcaagaaccagattattaaaacaagtggaatgagacagagatttttacacagttgcttttgctttcatggaagcctgggcattctggcatatgtggagtagttgcagtgatgtgatagaagtttgagaattgatgatgcagaaatgttgttttggagttacagagaacgtttttgttatcatttgagctttctaatgtcttttctcataatgcctcaaaactagtttttactgtggataaggacagtaaaaactgtgctaatatataaaaaaatctgtaccaatatcagtatcctctatgttaaacttttaatcttttgaaaaagtccaatatttctatccaagtaactgcagagaattcttgtataaatacatccttattaggaactttgtacaagtcagatattatcttagctactctgcttcagcattctatataaacatgacaattaatttttgatgacacttgaaagctaagaaaaaagttgaagaaggatgtaattaatatctgatttttggtgatcctgggttagaaagttgcaccactaatttcagactcaattctttatgtatctatatagttaaaaccaaaggtcttacagtgcagttaatttatcacttgcttagggtgaacaaggcattattagtcactgacacaagtcattgaggttcaaaacagctgtaggttctggaaggctagttggaataagagggctgtgtagtttgcatagtacataatggatgagcaactcaagaataggaagcctcagcctctgcatgcaaagttgaatgaaactaaagaaagcagaattctttagtcgctcctcattctttagtaaccctctcagctaaatacgttagtctgagatgcagcttttggcaagcatggggttactaatgtgctgtcccagtggcaaactatctgaaataaagaatgattctttatgaatgaatagagcagtttgatttagcagatggaacccagacagacaaaaaaaggcttataggctaggaaataagccctgtacaattaacattttcttttccatcagttcatttcataaccatctacattttctttctatttgtcaaaaatcctatatctaggattaattctataacttttttgataagtgtagggaaatatgacttatatatttctttctttttagaaagttttgtgtaaaaattattgtttttttcttgatgcttaacacagtattatcagtttagctctttttgaatatacagcaatgacaatgttcattcacgaatgtgtgcttggtcatacatgaccagtgtattttagaaatatctttgccttataacaatgcacacccttatatttatataccattcaaatatacatattttatttaactttgtgctattttgtaagataaataaatatatatgtgtatatatatatattccttttctctagaaagaatgacagttatgtgactttaattatttatctttacattttatctacattgtaaggtaaatgcagtatactaaagatcacgttttattttatgtggcttcatctatatgccaatacttgacaaaattgatcaatctaatttttttcttttttcaaatgaatatttaccaaaaccaaaattattcatgtctttctcctgtatatgattttttaaagcaaaatgtgtgacatttaaaaaagacatttacttttactattaaaatgtactatccatcgcaaaataggagagaaatcagtaccagtcctgtccacgtgtggaaaatcaatttaaatcacaggtctactggtgattacttagtgtcatcatttcaatattataaagcctaacagagggctttaaagagtggcagagacatgttttattaagttaaaagttgcattttattttaatatttaaaattcctatggtttttgcagtcctgtgacgattacctattcctgcattcctgaagtgaacactgtgtgcattgattgagaagttaggttttgaaaagttagaatatttaagacgttgaatgtttgtgatttatcagaattcttatagagctcagattgtgtagaagggaggaattaacaaatatttattgtgaagctgctgcagtttcaagtctatgtcaagcctacgtcatgtattgggaaaatgctgaaaaggacacagacccacaagagctctgcagacctgttgggaagtaaaaatctggaatgaatcaaatgatgagaaaccagcaatatgtaaaatgtataactgcagggacactatatgttatacattgcagttctttaaatgtaaagatgcatgaagttataaatggagttctgagtagtcttctgatactggattttgtctggaggagaagggaaatgggggatgattggaagtgtgggtcagtggaagacaggaaggagatgtggatgactctctgatatttggctttaaggtcaaggtagttggatgtaggtggcaaggaggaaaagcaggtggtggcactgctgatgatactagtgaaggggcatggaacagggacagtgatttctgttttggatattgtatatgtaaggtgtttgtgtgacatttatatgatgtctgtggcagttagttataatgatttggaattagagggagagatgcagagattattaaggagcaggcataaaattataagataaagggtttaggcagacccttggggaataataacaattgaggggcagaaagagctccagaggccagggaaggagattgaaaagggatggtgaatgagagaggaggagaataacattgcgaagttattggtgacctctacctacgcttactttgtcaccccatgctgttaagcttttttaaaaaatttatattctatcaattcttactactttttgtgtatttgtttattatagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtaagtaggctctttcttactgatgggggctaatgagtatgaagtaatgtacagacactatttttaaaataagatcagcatatagggttaacatcttaaaaagcttcagcatgtacaagaagccttcagtatgtcatttgaaataggtaactgatgagtatgtgatttttccatcatcgtttacagtattagatagaatgaaattggaattaattgctcacagtgagtgtcggatattttgatgtgacagctttcagatagttctatgacattcgatactacagtggtagccaaacataaacttttttttttttttctttgagagaggattttactctgtcgcccaggctggagtgcagtggcgtgatctcagctcagtgcaacctctgccccgggctcaatagatcctcccacctcagccttatgagtagctgggactacaggtctgtgccaccactcctgcctattttttctttgtatttttagtaaagatggggttttgtcatgttgtccagtttggtccccaactactgagctcaagtagtccacctcccttggccttccaaagtaatgggattacaggcatgaggcattgtgcctggcctataaacctttttttttttttttcttaatggccaagacatggtaccacaggtgtgcttgacctacttcatttctgagcattccatatgcttgggttggagtgaggtggccaggttgggccttatgcttgatgatggagatgatagtggtaaagttgtggaatgctaaatcttaagaattttttactttatatatacaatatatgtaaatttttgcatatagacatacaaaacgttcacatgcacagcaccccatccctccccttgcccccaccccgacatgccctggttgaatttttctcttagggatggctcttccttcagccttaccatttcctgagtcatagttgatccctgagaccttctccaagtcccccacacttaaatttgatttaaacctagttgaggtttggatcagaaagaaggagagctgtttttgttatcaaagccttatgttaaaatatggtgacctcaatttccattgtatattagcttctataaatggacagagaagtttcatttttcaagatggttttgatttttcatatttttctgaatacactcttttcttcttaaaacggaaaagcatttagtttgctcttaaagagttgattgcttttatcttagatagctgtaaatttaccgtttcatatttttcccttaagaaaaattagcttttaggaagttttgggctccttggacctgcattcttccctgttgggaaacagcagaaaaactaggagttttcctttgtttgttccagatacagcctggatgatgcccactccctcaaggtgattcagggccccagccctctgttataagaatctttgctcactagtctcaggttatgacgattgttagctgaagtagcagaatgattaatggagaaaatgtcttgtttttttttttccaagatgagcttaaagggcaaagaaaaaataaaacaggatactcctcttttaggagcataaaaagaatagtgtaatctagcattaaatattcctttatattcctcctttgaaaaaaacttcatcatgatatgcagcgatccttttattatacattttttaaagtgtactgcccttgaatgaaacctccaaatacaatttgtttcagaattattataatagcttccatttatttagcttatactgtggagaggcactgtcctagatactttacttaaacaattcctaatcctcaccacaaacttgccaaatagggaatcattagctttatttcacatgagaaaattaggatcagagaggttaagtaacttgctcaaggtaacccagagtcatgataaaaatatctgattttatttctgtggtatttatcctattggttagaattttttttttaattttacccccatcacttaggatgtattttatatgagataattttccagttttaatcaccggagtttatttttcagtttatattgtgatagtaagttcattttattttcagagaacctctaatggaaatatattctttagcaagattgctgtatgtttttcacaattctttgggttttaaaatatttgccttttattaaggcaaacccagattagacacatttttgggtgagggtagttttgtatataaatttgattagcaaaaattaataaaaatatatctaaagtgatttccatgcttaaaggattgtttggttgtgttttaatgcatttaatagttcgcttctctatatagaatacatatgttcacacagtaatatatgtacaaactaatatcaataccaaagcttatataatttctgaacatatattttagaagaaattgttctgttcttttctttttataaggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacaggtaataacccatttaggtaatgtttagtatcatttatgtttgagttctcttcaataactttgattttttttttactcttttttttctatataaagtaaaaaaaaaagtcaagtaaatagtgttatactggccttcagacttttctgttatttgttgatggcttctgattagactatgagtataattatatctttcagtgaatttttaccctgcttttcattgtgaagaagcactacagagagaatttatggaaggtatcagataaatatgaaacatagctaatatgttgttatattaaaaaaaaaataggcaccagcaaatctaaaatgttaggttaagcaaacagttctgctggctttatgttcaacagaagagaggactagagcttgtgagtaaaaagaaaacattaatcttcatgtaataaaattctcttttttacatggaacttaaacattaattttatgattattttctaaagaatcaaaaattgcacaaaattaagagatactttttcagtaataaataataagaatcaacagcatttctcagtgggtaatttatattaagaaaacttcacaatctctcaaagagttttttttttcagtttttcagaaaatcctttctaaatatataaaatactgtgtttaatgatttaataattctaaaaaatcagaatcagtcttatccctaacacaagtctctttatatgaaagttgattcatattagagaaggttactgtgacttgagggctttgtgcaattcatatttagaaacaataaaattcaagataaattcaagggacattttgtgttacattattcaggactaaagtagtaagttattttatatagtccatggatctctctataacagtgtcttatagatttttctttgtagatgctttgtctaaacacatttttaaaaatctgatgggtaactgatttttatttttatgtgaaagaaaagtatagaatgtaagcaacaaattattgaatgtccactgttccttttgctttctttcaaaaccacgttgtgtttacttcctttcttacataaagagtaaaacaaaacaaccaaaataccaagcaaacaaaaaaaccaaaaagcaaaaaccaatttacaacacacacacacacacacacacacacgctcgcgcacacacacacacagagtctagatgacttatggttttaatatatgtttcagactcgatcttaagaaaaggtatttcatacgatgaaaaaatcagtaaaatgtaatgaaatgtaaattggaaattatttttttcatttttgtttttttccttaagtaaggtgtaagcattcagtggacaatcttgaaaacaactaaagaaacagaaacagtgatgataaaccaatgctgtgggaatctgtagaaactttgttagcttagctgacagtttctactctcaactaaatgtttaaagaatgatttacactatccatctgcaaattgatagtgactattctttatattctttctaactattcatttttaaatcttatgtaaacatttgaaattaagtataatttttaagggtttattttgttcttctttttctatcccctatgggtaaaaatagtacatagtaaaaaaagtacataaggaagtacaaatcatgaggtagaaaatttcagaaattattggttcttttcaaatagaggaaattagttcaaatatatattaaaatgttttaatttgactagtaattggtgcatacttgtattatctcatttgtgtgtgaacaagaatgagcaaattacatttgagtgttcagaaacatttagttaaataaaatttagatactgtattttatcaaaaactccctcttaattttgcaaatttttaacaaaacttgagtgaaagaataaatgaatgatagcaagcatgattacaataaatcacatcacaatattgcaatgaaaatagttaacagtttattgtgataacagtttataatttcctctcaatgtcaaatccaagttcaaattctctatatttcaactcaatatagacaaaagttgccctgatactaaaaaacttgtggtgctttcaaataacatgctggttaaaaatattctatttagttttcctcaaatcacaaacaatgtcattatgccagtttatttcagaaaaattttggtgtatgtggtatataaccctatatttataaatggtgcatttgactttaaaaatgaagctctagggctctacatttgacatgtgctttcaaggctgtttgaaaatgaaatacactgtggatttggaaaagtgttttggtttcctgatgccaagttgtatttaagtaatttttggcagaattaaaaggtgcaatgatatggcttcttcagtatgttcctgtgcaaatgatataggtatagatttctctagttacacagttttgttttttctaactcaaagaacaactggctttagatctgagactaaaggtttttatttttttttaaatctaattaaagctactaagtaattataagcagggctgaatgaaatttgttcagctgctgtggtttgtgagcctgtacagtgcttggcaggcacaggcgccttggaggaggcctggaaaggaatgtcttgaatgggtcttgacaagcttgctggccatggggtcatcttccataagtgggaactgccgaacctcttgctagcatttgtcaatagcaaagaatccagggtgcagagttcccataaaacgcacattactagctcttgggaaaaaaggaagcctttctttagctttatttttcccttgccattctaagtttctcacagtattagtgagattttagcaaatggtgccctgcctcctttttccccttcccacacttctttctgtgttgacagggtagaaactgaaaggtttgtcgtgtattttgggtaagtgtacaaaataataccttgtttttggtgattcagtattttgttttgcaagtgattgtttttggacgagactgctgttctgcatgattacaggtcttgggaaattttgcttgtccacctggccatgcatgctttgtgtgcagtttcattttctaatgataaggggagcttacacaaagttgtttatttatttttggtcctaagagttttgcactgtgaatgcatttaaagtattttgaaatttgagaattagtgtaatgacatttagacgaacttaaaatttttaactttccttgtaggtccacataacctcaagaacaattactgtgctgtacttctgaaatttttacccaatgtcttttatgaatcttgtagcttgtttaacagagaattagcaatcaattatctgaacggttccattggttttctgagagcatctaagcaatttattgcttatatctcagagccgtatacagaacttttcagaatttgcatttcacttaagggtagcatattttaagaaagtttaaaaataaatttgtttaatgttcagaatggatttttatattttgcattctgatccagttttttctttcctagcttatgtggatataagaaattttaattaatgaggatattgatataaatgatggacaaatttggtatgaaaattatgactgttttaacaatataaaataactctcctattatttagactattctgtggccactagcatgctaagtattatcagatttctaaaaactagggaaggatgacaattcagattctctgttaaataggaagtgagctttttttctacatatttctacatatgaattgtggtttcattgtgatttgaagtctgagcatgaatatatttttggttcaataggacgtgacatttcgcaaggtttagagcagcttgcaggattgataattcttaagagcctgctggcttttaaactctcagaacattgcagtccaagtccctttgatcattctaattatgctttgaacgttaaaaccagaaatttaaaaaacatgttgttttaatatgttcttttggagatacgtaggaattggtataacatgtcatgcatctcagatctattctattcttttttttcttatattccctacattttcttttatactaaaagacaaaaaagcacaggtttaaaattaaggagaatagaaggcatttgaaaccacaacatattcctaaaatgtaatcacaattgtgtttattttttatcagcgtggcttgctttagtccatttagttatccagctattatgtgctctattcagttagtataatcttatgtaatgagttttaaaaataaattcaagtgtatgtaaaattgaaacacaattttgttttaagctatcttctaactacatgttacaaattaaatttttctaaaactggaatcaaatctgcaaattttgatgctttatataaataaaatatattgataacatttggttacagtattcttggtgtacatatgtagtgtttggtttttgtcaaataaaaaaagatgtaatgaattcagaaatagaagttctttcataactgttatgagtaaaactgttttgatcttaaatgatttcaacacacgtgaattcacttaaggtctaattcctcatagccttccttttcattatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcagagataacatccacttttcttaccattttagagtagtatcattgtttctctttttctctttttggacaatgtatacgtatttctggtgtctcttaattgataggagaatgttaatttttaaagaaatgataccacctcttttgtcctttcagtgagttatatgcttctgaaactttgagtatattaatattcttgaatatttatgtttttaaatttgttgtgaaaagtcaactttataatttccatactttgacacattcactttagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtggtaatttattctgtgtcttatattgtatttctgtttactgaagaagaaatataatttttttagttatttctttagtaactagttatttctagttgctcaccctgccttagaaattacacatagtgcggaagttttttttagaatcatatttaggaccatgatttttatttcttacatagtatcgtgatgatactgatgacttcagttatattttgataccatttaagcatatgcagtgcaactcaaacactcaagaatgagtccatccaaatagcgagaaccttaaaactaagaactactgctacggaactgttgaggtgactggaaatgataaatagtttatttttagagcagtgtctgtctggataaggaaatcacacttgagcatgcagcttcctgtaactgcttttagcagatatccttacaggactttatgataggtgtgcctaattcgtcatcattctgtttcccatgccaactgacttctaaaatcccaaactagaaaaaaatgagtccatttactttatttattatatacctacagagggaggaacaggctaatatatttttatatgtaccttaaaaactgtgctaagcaaatagttggcagttattaaaaagaggtgttgtttttatttttgtttatttaaccgatttctttactcatcattttaaaagtttcgtatgtcttcatatgtattatgtatgtttccatttcacagctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgaggtaaatattgcatataactttctgccttacttgttgtagttgatcaataattattttttattaaataattaaacatctggtaatatattttgtgataaaagtttgtaataaagaactcaggtgtgacagtgtctgaccataaaccagaagagcagtattatgttttggtttccctgaagacatgttgaactctagaactgagagtggtcagtgacactgctcatgtatccagtatcagggattcttagttggagaggcgaagccctcggcttgtatttagtccctttgaaggcaaggtcatctatcaagtgtcctgtggtgcagtctcagcaccgggacacggggtcgcatgagtcatggaccaaacatggcatttcttcttacagatagtaaagagaaagatcttaataacaacaggaagtgaacctttcctaggagagtgacacttagaacagctgtggaggccagtcccctctccctcagacccattcctcaagagacaaaattcgaatacctttctgttttagggggaggggagcaccagttcacagggatgacgtgaaaaagaaacagcgtccacctggggatccatttaggctcagaaatgtggggaatcaaatcttgttaggacatggagtgaggcctttatgacccatgcagttaaaacttcagtaaggtttgtaagaagcctttgtgagctggctgagctttagttactctaaactctgctctaaatgttcaaaaagttatttttatgtttcatcttaaaaatcaacatgtctcccattttcctgcagaaataatatgacctctgtggtatatcagtttttagcttatataaggcaaaatatctatatttccattaaatttcatagttagtctaaatgaagtggctgtttgtatgaatgcacatgaaactaatttttgggggggtctgagtcttacctgaatgtgttaggggaagttctgcctccgaaaaggaaatgaataatggtagtgttaatggtgcttttttaaaaaaactgaataatttaagaatatatgatgtaatttatatgtataagtcacctgacttaaaacgtgtaacattttccaaagattccagaagaaatggaagaatttaccgttatcctactgaatggcactggaggagctaaagtgggaaatagaacaactgcaactctgaggattagaagaaatgatgaccccatttattttgcaggtggtattgctgtcttatttgaatgagtttacatatttcttaaatagtatatataaatgtatatatgcacgtgcatatatacatttatatgcacgtgcgtatatacatttatatacatatatatttagcaatttttttcattgaacattttcaataaagcacaattgatgcttgtttaaagattttgtaattcattcgaggattgttatttaattgttcgaagttttgactaatacttcaaaaattttttgaagcaaaaagaaaataagtactgttttattatctttttccccctttcagatttctcggtatttttttttcttttgtgcagaaaacacttctccatgtgatttcttcaaataaacagtctagttggttcagggctagattatgtattagaaggacctgagtattatgcctaatggatggccatacactataataactaatttttaagggaaatattaattaaaatttcttcgttttgccactttaacgctttcttcagaactgtctttggccacctgaggcatcttttggttttgtttatgaaacggttgttgtgtaactctttcttgaatccttgttgtcagctatatatgggttaatttacctaatgcaggaattgcaggaatcttgtaagccttttgtattttattgatttgtattctttctttcttcttctttttttttttttttttgagatggaatattgccctgtcaccaggctggagtgcagcggcgtgatctcggctcactgcaccctccgccttctggattcaagtgattctcctgcctcagcctcctgagtagctgggactacaggcacacaccaccacgcccagctaatttttgtatttttagtagagacgggttttcactatgttggccaggatggtcttgatctcttgaccttgtgatctgcccgccttggcctcccaaagtgctgggattacaggtgtgagccactgcgcccagcctgatttgtattcttaaccttcagttaatgtgtacttaatgaattagccttatgttcaaccttctggtaactgctgtgacaaatataaaacataagatctctgggcctgttctcaaggaagttacatcctcaacttagaaatgaggtttatgaaatagtaagcagaggatttgaaatagcatgcaatttgctgagaaattcgatgttgaagataatggatttttgtaggattaaggcaagaggatggccattgactgttgaaataatcagagggtagtcatgtcagagttgggaacagagctaattattttggcaaagacacagtacaaggcttctctcttggagggcagggagaagcacaatgtgatctgaaaatatgtgatggaatcagaaaagctcatgtgttctttctttgtggatatttcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtaagtaaattatgcttttttatggcagatctgcctcagtgctttaataagatgaaattaagcactgcagtccaataatgaggacaagtagggcctaactacatttgtactattcaagagtaaaattatttcattgctttcttgagaaatggggtgaagaatgtatgtgttgaacctttatgtacttgttgaacctttatgacatcctttttaaccttttctttatgatatggcacaaatagaaaattctgatatataagtaagtgaattcttacagctaaaagtaacaggacttgggaatacggcttccctaggtattgcttagtcacccagcgacttaagggataggtatcctgtagcattttccttggagcagggtgctggcacacttgattgggaagcttaattctgtaggcagctaacttcaactgtttgataattctctggagccatggccaaaatgaatgacaatctgcaagtgaaaaagatgtgttcgtccttctccatactgtaaatgaaacaggatgttttaaccccactctttgggatttgagaatgttttggctctaccttctgtaaattggaaaggcctatggcttctcttgatagttattttattcttttaatagtacaaggagtttttttttccttgaaccttttgagagtaaggtaaagacatgatgtcctatcaccctaaatacattagtgtattttctcctatagagatgcccccatgagctctaacgtttgcatcgggtcaccatgatgccctgtctgccacccccagtggaatgccaacgttgtgttccaccttgtgccttttggactgaaagactgaggaagagaaagagatctcttaattattgttttagctgtgtctttcattctccctatctctttgactttcttcattgctgtctctgtttctattctgcttcctctttttctccttttgtctttctctgcctctcatttttcacacagcttaacaaagaagttaaaactaaaaactattatcctgtgaggaaaatttgaatttgtagaataaacccacaagggcaatttcacaattgcaaaaaacatcgtcagatcttacgtagactaaaaacatttggtgaatccattcgttgttctaaaatttaaatgaaaggagttgctacagataaaaataattttagtgaagtaaaagtggaaaacaaagttttactgtgaaatacagaaaagcgatgaaggaatgatattattaatattattattttttacggagtctcactctgtcaccaggctggagtgcagtggtgcaatctcggctcactgcaacctctgcctcccaggttcaagtgattctcctgcctcagcctcccgagtagctgggactacaggtgcacaccaccatgcccagctaatttttttatttttagtagagacaggttttcaccatgttagccaggatggtcttgatctcttgaccttgtgatctacccgcctcagcctcccaaagtgctgggattacaggcgtgaaaaatgatattatcttaatagaatttatttactctagaaataagttcttgatgacatttattaacttagtgtgattctggtaaacatttttgtctcaaaaatatcactgtggttaagctgtcattaggaaaaaaacgccaatatggttaaatagtgaatgaatcaaaacatcctgaaccttttgtaaagagtaggggaactgacatttttttttcttttttgagatgaagtctcactctgttgcccaggctggagtgcagtggtgtgatctcagctcaccgcaacctctgcctcctaggttcaagcaattctcctgcctcagcctcctgagtagttgggactacaggctggcaacaccacacccagctaatgtttgtatttttagtagagacggggtttcatcgtgttggccaggctggtctagaactcctgacctcaagcaattcgcccgcctgggccccccagggtgctgggattacaggcgtgagccaccgtgcctagccagaaattgacgcttgaaaaagaggtttagttagtttgtgaaatatgtcattgggaaaatatatttattaatatttgattttgagagagagagagagagagggagaacacaagatgtgattgggttactggcctgaggtatgtgtgctacctcgtactgctgctgcatttgtctttaatatttttccagaaatgatgacatttgagaatccaattactttcgttaagaaggctcagatgacaaaaatctctagagcttgtgattttttaatacatcctttcttagctctttcctccttttcgatgtcaaaacatcaaggacttgtgggacccatgatgggacactgtagaggcagcatctctgacatgacctagtgctggcagtggctgtttatcctgatgctaatcatttagagcatatgctctgatattggatcaaaggatatggccatccttcaagcccttgttaaatattgctagttcatcttgcagagaaacagaatgaattttcagcaccactgggacatgtttcattacaaatgcatatgataatagaaccctgccaaaattaggttttattattatttatttttgttagattttattatatgctctttatttattgtcagcgttttctacacaatgatttgctatttttgtgtcttttttccattgaattatcaagtgaagttgagtacagttgtatatttgtataatttttattgataagctggtttgctatatataaaatttgtttctataattttagctgtaggtgttgtatacatctgtttttgaaagtgttagttgcatcagttcagcaataaataaattctgcgcaccggttactgagcatctatttttctagggcatggaattgaataagaatcattagtccaatgagcttatagtaaaattatgtgtatgtctgtatgtgtatgtgtgtgtgtgtgtgtcccaatataatatgatcattgttatgatagattgacaaagagcaaagtgccgtgggagcacactggagaggcacttagcttaacctggggattcaaggaagaattcctggaagagttgttgcttgagctgggttctcaggaatgataagttaggtgagtgaagatgggaaggacttttgctcccctgtgcaacagctggagtaaagatgaagagataggcacttcagggaagtgatgagaagagacccaatgtgtaggcaataacagtgccaatatactgtgcaaagaactggagtagaaaggaatcaagcccaaaccatggagactactttgttctatgtacaaccagatcaaactttgctgcctgaaggcagagatgtaaagggaaacactcaagccagtgattccaatgaacacagacagtagtatttttatgttattgggtagtcctttattatttgtatgaaataaaagaatccacctaagaaatttgaaaatagaagaaattatgtttttaatttctaattaagctattgaaggtatattccttttgtgaagaaaagtgtgtttttcaataaaatagttcatttgtaactaaaaaaaatgggaactatttcatcttgaaattatgtaggcatctctctttctctctctctttgtatgtatgtttgtacttatgtgtgtatacataaacatctttggaaatatggagcagtattttgcatttattatatgaccttcagtgaggaaattcttgctgaaattttcaacttaattgtaaactttcttaatttaaaagtataaattttacagcaagttagctacttctttgttattttgtcttttccacttttaatttaggtgatacagtagtatatcaatatggagtagctacagtaataattgaagctaatgatgacccaaatggcattttttctctggagcccatagacaaagcagtggaagaaggaaagactaatgcattttggtaagcatatgtagataaggcaagtttaaaattgggtgaaataaaaccattaagtatgtgaaattctgaaatattccttcaaaatttaaaaattggttaagaattgagtaatttcaaagttggcagtctgaatgagtggtaaactttgtttatgctgttgccacttatcttcaaaaaaaaaaatcttttagctagtaagcagaaattattctccccacccccctcgttcaaacttcaatcctttgtgagactgagaaacttgaattattcaagatcttcaggaactcttctctcagatgatatgtgactacccccaccctgtactttgcttttggaaaactttttccaactgtcatttagtattttttgatggagcttagaatttatctttcagtttggattttgaagacaagacttttatgactgtttctcttttattaaagttctaccttattcttctcttcccatgaaattcttcatagtttgcctcgtagaaccagctggtttgtttcttttaagacaatagatagtaaaaatatgtttccttaataacacaggaagctctcattagagtaagattcactacttataaattttctttaatttattttgtaggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtactgtgtttttccatgtcttattttatttccatgtcttatttatactaaattttacattttatacttagataattagagccatatacaaaatgcaattggtgaagtatttgtgtcatgactatctgattttaaatgttaaaatacccttcttgtttcaagtgttattcttaacattcacttttttgatatcttagtttggttcagttttagggatggaggcctacatccatcctcaaacatgcaaatagactttctccacaccaactatagtgtctccaacaagacgttagtggaaggtaggaggtaaggattcatggtagcttaaagcttgatctttgtgtcataatttaagcaatcaattttcgcatcacttttggttttaaaaagcacagaattaaacctttctaattcatatactcttttcaggcttgactgattatcaataaaattatgctgaacaaatattatttcatatcctgcccctaaaatgtggtgaaagccacatggtgacactacttttcattgataatgagtaaattatttaaccagaagtttgtctgctaaacaaattcttttttcttcacattatactagaaagtacttgaaattctagtttctcactcataaattttcttgttacaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatcattataagaatcatttacagtcattcagagatagccactataaacattaagcatactgttaacatgttcgtatacacacactgtatacatatttcacaatttttcttctttattgtcaaaatgatacatgtatattgcatgaaatttgaaaagtatagaatagtattaagatgcagagtgaaagatgccatattccctccatgaaccactgtaacatattggcatttttataacttttattttgaatgatttagcattgtaacttaagtagttaacactacaagtagagaaataatgatcaggtttgtcccagagaattagtcatagaagcaaagtgcttagaatcctcaaatatgtataatgttttacatttataaggcattttccatacattacctaatttgtacttcataataattcaatatattaaatagaggtcagagtcagtaaataaattcgctagcatcacacaggcaagtaacagaggaaccaagacatgaaaataaaccattaactcctaggtcagtattccttttaacataccatagagacagaactaaaggagatgtgatcatttctatatccttgactccagatagcatcctaacagtgagaaccatgatgtggttttgtgagaatcaggggaacttatatcattacagttgccagataattcaataggagagacaacataggatttcccattgaatctggagctccagtgaaaaggtgtttctggtttgctgggcaggaaggtggtctctgtagtcggtatgggagctgtcatgacagtaacatgccagatacttgtgactaccctgaaagacatctgggtggagatttgtgaaacagcctccactgaggttattgacaagaaatattgcttgtacttttttttccagaatctctgccaatatctcatcttgcctaaagatcttacataaatatcttagttgagttattagagtacgaacaggtaaagaaaggagaactagtgaaagcatgaaaaggtttgttattgagatatagtgacacagttgggctacatgttattattatttttaaaagtccccaagacttacatataatgtttctgagaagaaatatttctatttttacatctattctcttagttgtttggatagagagatatatttggcctgtagaaatacttcttatgaattctcacaactttaactcaatgagtgtctaacatatcaagccttgaagttcttaaataataatatagtactgaagtttaaaaattgtgatgaggctaggtgcagtggcccatgcctgtaattgcgcctcaagcgatcctcccatctaagcactttgggaggatcgcttgaggccaggagtttgagaccagcctgggcaacatagcaagaccctgtctctacaaaaaaaacaaaacaacaacaacaaaaaaagccaggcctggcagtggactcctgtagtgatgtccttgctatttgttagtctgaggtggttggattgctcgaacccaggagtttgaggtcacagtgagctattaacatgccattgcactctagcctgggtaaaagagcaagatcttgtctctaaagtacataaataaataaatacataattaaaaattgtgatgaataagtccatttttaaatgtgcaagagtaaattttaaaataccatagaataaatttctatccaaatacgtgcacatacatacatgcatacgtgtgtatgtatgtgtgtgtatgtgtatgttcagatacttttttttctagaaatgttgacagactgatagaagttacttttaagtatatcatctaatttgaagatagttaccaattcttttagtacaaaatataaatcctaatgattatggattccttttttaaaatcataatagaagataatatccaattcattgtatactagttatgcaaaagtttcatttatccaaaaatatctttcagtaaaattgtcttactttctgaatcacacgtaaaatttaggacaggacacttgaaggtattgtagcatttaaacttgtctctaatttcaggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagaggtaagtagtgagcttggagaattttggatttaaaaattcattgtaggtggatttgtttgggactcggctttctttcatttggtaagattggttgcgcatctactccaagtccagaagtatgctagggccagtgattgcaaatataaattacaaaattcttactcttatgagttcaccctttggatcaacttaatgagctgatagaagtaataacaagttagcaaatgaaactttagcaattcgcctgaaagttaatgctcttcaaagaacgtatgtgtatactctacctatttatttttggctactgttttggatgtcattaaattgaatgaaataatatatattgaaggcttgtatgaataattgtatttgcaactttattaaaatatgattttttgatttttttttttttacatgtgaaacgtacttgagtagttagttatcactttcttccatgttgggtgtaaatacctttcttatcaaccttcttggccagcttaattcattaggctgtcttactgtccttatcagttctttccatgttttcaaagattcgtaatcatcttggtttcctgttcagtaatgtgagaactcatgaaactacttcccaggtgttctgtgtgacagcaacagcttggtgaccatgaaaggatgccaaggaacaagagtctttctttttgcaagttgattctaattggtttagaaggatgtataagtaaattgaaatgattttttaaaaatggatgagtagagtttgaaaaaaaatctaggtcataggctcattctagcttaaactgggatgtctgcctctctggagtgtctttcttgccactttagccctttggtttggtggcagtcttaagagatcttcaaatagtatggtcctttttttacatcagaaatagcatatcctagactagcaataacaaatgtcatacaaatctacaacttgaaaagaaagatgtttacatatagtggataatacctttaaataggtattcagctatcaaagaacttctacatattacattttatgcacctttctgataatccataatataggtgcgttattaaccagtgtgatagtgatattaaccagtgtgatagtgacattaaccagtgtgattattttgtataatatgtgtcaacattttgaagatctgtataactcagtaactagtatttttcaagtaatcaatgcatattgttgcaaatcatgcctgggtaaaagactgttccaaagtacaaggtagaccagtagattttaaagtactagagtatgtttccaggttgcagctaaatgctaagaaactgccacttgtcaaattttggattttggtataatgtcaaggaaaaatacccataattatctgaaaagactagtaaaatcctcttcctttttctgttacacacatgtatatataaggctggattttctttatacactttaaccaaagtaaaagatagaaacaggccgggcgcggtggctcacgcctgtaatcccagcacttcgggatgctgaggcgggcggatcatgaggtcagaagatcgagaccatcctggctaacatggtgaaaccccgtctctactaaaaatacaaaaaattagccgggtgtggtggtgggcacctgtagtgccagctactcgtgaagctgaggcaggagaatggtgtgaacccaggaggcagagcttgcagtgagccgagatggtgccactgcactccagcgtgggtgacacaagactctgtctcagagaaaaaaaaaaagaaaaagaaaaagaaacagacaaattgattgcaagaggagctaggagaatccagctgtcttctattaagccagacattaaggagacttttaaaaatataaaataatacccccttatcactaattttttttcgagaactgtagttatttctcataaaatatgttgtttatgttagcatgtaatgggtttattattgctgtcttaaaatgagttatcaatatttaaatttttaatttttcatttgaatatggaaaatatcagcagattttaatgatatcaacaaaaactctctggggttctcaatagttttgatgtgtacaggggtcctgaaactaaaacatttgagaactgctggtttagtctgtgcttgtaattatcttctgagttcaaattttatgatcacttgcttcatttttagaaataaagactacagccacttccatagattcttctccattatgttgttgcaatgacattgacaatttaacgttaaaaaaaattccctcaaaatttctgaatgcaatagagaccctataaagactctgggctgggcacagtggctcacgcctgtaattccagcactttgggaagctgaggtgggaggatctcttgagcctaggagtttgagaacagcctaggcaacatagtgagacccccttgtctattttaaattgaaataaaaattaaaaaaatttaaaataggccttctgagttatgttatgcttttacctttttcatagattaatatgacataaagtaatattaaggttaaaatgatagcataatgacatcttaaacagataatgaaaatatgtagactctgacatagcctgctatttggcacattgaaagagaaggtaattattctgtgatttgttttctaccaaccaggtacactatgtcccggcaaagagcaggtgcttaataaactataattgaaagaatgaataaaacctgtgaagcagtttagggtcctggtgaggcatgccaaatagtgctttggattccaagtgggatctgtattgaacagaagatggattttgttagatctatagcctagtaaccacattctcatgtttcttccccatattttgttgttctgtgtatttcctatgttattttctctgtaccatattttagcactgtttttacgtgtcctgccaaattgtataccacgtaattataaattaatgaagttgctttcatagtgattcatagaacttgctaatcgtattgttttattttttataactaatacttgcattatatgttatatttataaactatggcttaagaatcaattaaagacactttgggaagatcttcatgaaaacaagaatatcatttcaacttggactatatttgtttttaagtgcctaccatgtgctatgtgaatagattccttgggatataagtgatattggtataatccgatatcaccaatcatcacccatgcatgaaacaaaattaaaaattaattggatttgtagctttaattttctattgcaatagagaaggccaattcatggttcagaatactgcattattttttctaagaaaataggtttcaaaaactcgtcttactatttctgtttattattactgttctgatgatctgaatatttggcaaattcctgacttaaaagaggagacggtagtgagtattattgtgtctagtgagaaactgtttggggatggtttgatgattattatggatgttaggccccttcatatactggcctaaatgtttgtttgtatcataattctaaactcaattagatgaatattttaatattagaaaaaaggtttagatatttattttctatgtcttatgcatttctgtattaataattacataccggagtctagtatttctgaaagtgttgcccttggatgaccttgtcagaaatatctaatgcttattactggacattattcctgactcaggaccccattcctggatcacaatctctggctaggggagaggggaagtttaagctgaattagaaaacctttttaaatgaaagttttcatatatagagtatacacaaaaatagagaagataaaggaatgagtcacagtgtactagcttcaataattatcagccttttggcaatattgtttaatcatttttggttaaacaacttttttttttttttttttttgagacggagtcacgctctgtcgcccacccaggctggagtgcagtgatgcgatcatggctcactgcaagctccacctcccgggttcacgccattctcctgcctcagcctcccgagtagctgggactacaggcgcccaccaccatgcccggctaattttttgtatttttagcagagacggggtttcactgtgttagccaggatggtctcgatctcctgacctcgtgatccacctacctcagcctcccaaagtgctgggattacaggtgtaagccaccgtgcccagccagttaaagtactttttaaagcaaacctcaggcgttatgttatttctctgtaaattcagaagtattaaaggtggatttgcactgagaatcctggtagttttttttttctttttttcttttttttcttttattattatactttaagttttagggtacatgagcacattgtgcaggttagttacatatgtatacgtgtgccatgctggtgctctgcacccactaactcgtcatctagcattaggtatatctcccaatgctatcccttccccctccccccaccacacaacagtccccagagtgtgatgttccccttcctgtgtccatatgatctcattgttcagttcccacctatgagtgagaatatgtggtgtttggttttttgttcttgcgatactttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctgtttctccacatcctctccagcacctgttgtttcctgactttttaatgattgccattctaactggtgtgagatggtatcttattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctcttgagtttaattaggtcccatttgtcaattttgtcttttgttgccattgcttttggtgttttagacatgaagtccttgcccatgcctgtgtcctgaatggtaatgcctaggttttcttcaagggtttttatggttttaggtctaatgtttaagtctttaatccatcttgaattgatttttgtataaggtgtaaggaagggatccagtttcagctttctacatatggctagccaattttcccagcaccatttattaaatagggaatcctttccccattgcttgtttttctcaagtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttgttttggcttaggattgccttggcgatgcgggctcttttttggttccatatgaactttaaagcagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcctttgtaagttggattcctaggtattttattctctttgaagcaattgtgaatgggagttcactcatgatttggctctctgtttgcctgttgttggtgtataagaatgcttgagatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaatgttgtcaaaggccttttctgtatctattgagataatcatgtggtttttgtctttggctctgtttatatgctggattacatttattaatttgcgtatattgaaccagcttgcatcccagggatgaagcccacttgatcatggtagataagctttttgatgtgctgctggattcggtttgccagtattttattgaggatttttgcatcagtgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccgtttggtcctggactctttttggttggtaaactattgattattgccacaatttcagaacctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatattccctttatcattttttattccgtctatttgattcttctctctttttttctttattagtcttgctagcggtctatttattttgtcgatcctttcaaaaaaccagctcctggattcattaattttttgaagggttttttgtgtctctatttccttcagttctgctctgattttagttatttcttgccttctgcttgcttttgaatgtgtttgctcttgcttttctagtccttttaattgtgatgttagggtgtcaattttggatctttcctgctttctcttgtgggcatttagtgctataaatttccctctacacactgctttgaatgcgtcccagagattctggtatgttgtgtcttcgttcttgttggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcattcaggacttgctttttgaatgtgggtgctcctttgttgggtgcatatatatttaggctagttagctcttcttgttgaattgatccctttaccattatgtaatggccttctttgtctcttttgatctttgttggtttaaagtgtgttttatcagagagtaggattgcaacacctgcctttttttgttttccatttgcttggtagattttcctcaatctttttattttgagcctatgtgtgtctctgcacgtgagatgggtttcctgaatacagcacactgatgggtcttgactatccaatttgccagtctgtgtcttttaattggagcatttagtccatttacatttaaagttagtattgttatgtgtgaatttgatcctgtcattatgatgttagcgggttattttgcttgttagttgatgcagtttcttcctagtctcgatggtctttacattttggcatgattttgcagcggctggtaccggttgttcctttccatgtttagcgcttccttcaggagctcttttaggacaggcctggtggtgacaaaatctctcagcatttgcttttctgtaaagtattttatttctccttcacttatgaagcttagtttggctggatatgaaattctgggttgaaaattcttttctttaagaatgttgaatattggcccccactctcttctggcttgtagggtttctgccaagagatccgttgttagtctgatgggcttccctttgagggtaacccgacctttctctctagctgcccttaatattttttccttcatttcaactttggtgaaactgacaattatgtgtcttggagttgctcttctcgaggagtatctttgtggcgttctctgtatttcctgaatctgaacgttggcctgccttgctagattggggaagttctcctggataatatcctgcagagtgttttccaacttgcttccattctccccatcactttcaggtagaccaatcagacgtagatttggtcttttcacatagtcccatatttcttggaggctttgctcatttctttttattcttttttctctaaacttcccttctcgcttcatttcattcatttcatcttccatcgctgataccttttcttccagttgattgcatcagctcctgaggcttctgcattcttcacgtagttctcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctggtgaaagtcattctccatccagctttgttccgttgctggtgaggaactgcgttcctttggaggaggagaggcgctctgctttttagagtttccagtttttctgttctgttttttccccatctttgtggtttatctactgttggtctttgatgatggtgatgtacagatgggtttttggtgtggatgtcctttctgtttgttagttttccttctaacagacaggaccctcagctgcagggctgttggagtaccctgccgtgtgaggtgtcagtgtgcccctgttggggggtgcctcccagttaggctgctcgggggtcaggggtcaggcacccacttgaggaggcagtctgcccgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtctgagcttccaggctgctttgtttacctaagcaagcctgggcaatggcgggcgcccctcccccagcctcgctgccgccttgcagtttgatctcagactgctgtgctagcaatcagcgagactccatgggtgtaggaccctctgagccaggtgcggggtataatctcgtggtgcgccgttttttaagcccgtcggaaaagtgcagtattctggtgggagtgacccgattttccaggtgccgtccgtcacccctttctttgactaggaaagggaactccctgaccccttgcgcttcccgagtgaggcaatgcctcaccctgcttcggctcccgcatggtgcgcgcacccactgacctgcgcccactgtctggcactccctagtgagatgaacctggtacctctgatggaaatgcagaaatcacccgtcttctgcgttgctcatgctgggagctgtagaccagagctgttcctattcgtccatcttggctcctccccctggtagttttttttaatggacgcttgacattcgaaagctcttttagaacttaaaaaatttactttattgtacaaaatattcattaaattttctataaagtgttgatatatagcgtgtaactgtacattcttttattagatatgaatagtgatttttttaaactgaaaatattcaggaagctataggttttgatgaaggttttagtaaataaaaatatagttaggtaacttttccctgtgacttttgcaaacaaaatcctcatcttagtcctaaatgctatgtgctaatgcttactgacttgataaaaatttaagtttgtaaaagaaaccattatacatttcttagtgtctctttggatctatttaactaatgcctcttgctgaaaagggaaaagattttatatttacatattaagattaatggtttattaatttaactcatgagatgttacgatccccattttcagaggagactgtgaatgcttgataagtggtagaatgaggaagctcaggactgcttggccttaaagccatactctttccaccacacatttgctcatgtaccattcggctagcatgaaaatcctgatgtagatccctaagtggaaattaaatctgatgttgtattgacacctgggtctcaagctgcattctcctcttctgtccaacatcttaaggttggagtgccctaccttcaggacagtcagttccgccatgacatgatggatggattcttaaaaatcatcacactatgccagatgcataatgagaaacacagaacttatggaaaagatggggttaggaaaacactgctcaaggacttggtcgttgacacttaaaaaaaatagagacctgataaaaatgttgtacacattaaatatttaatacttataaaccacaatagatatggcatattatctttaaaaaactttaagtttacttgtagaagtgggcatcagaaggattgcagcttgtgtgttattgtgaaatgatagaatgagcattatctaaaattggaggaaaattataacactagatgtggttaagtgtggctagtaacacaggtgttgaactgagtagctggtagttgtttgaggtatgtgtttgaggtatgtggcttgtttcacgtgggtacaattttctgtgttcaccaagtttcttgtggatgaaatagcacttataagcaaatgcaagttgaggctgtattcaaattgttccccaatatattatcaattgcattggaacaatttcatgatttcaaaataagtgttatagcagaattaaatgtacttggtcctcttctcctctccatctacactccccctgctgtcgcaactggttttcgaataccatttgtataattatatatttatccaccaattttacatggctttaaatatcatttatatattgataacttccaaatttatgatgtcaatctcatcttttctctaaaattccagactcatttctttagttacaacttgatgcatttctaggatatttatttcatagacacttcaaactaggcatattttaagccctttgattcttacccaaaacctgtgactgatacaggaggaaagtcaaacctgcttcagagatgcctgggcttcatatgttgctacttgctgtaagtgggctgatgcttctctagtgccctaatcagaggtgtttctgaaggtcagagggcagagctgtaaactgtccacttagccatttatcttttgtggatggagaaatggcctgaagtatgaagctactgcttcaaccctgagcagtgcttatggtgtagttgatcggtgaggggcttggaagaatcaagactagagacaaagatgtttggggagaagtcatgtgaatagattgccaggagttaacactgagtatgagggggtgtttcccaaaaggttctcaacaaccgtgaaatcagagtgaggctctgttgcatatcggccagactctcctttgtcaccacagtgccattaacagcatgatggtagggatggaggttatgcataggtttgacagcatgagctccctcttaccaagactgatgtagcaactggtggttgctgaatgtccaaacagcaagcagcagagaccaaagctaagtacttctcaataaaccatttactggtacactgatcccaaccagactttatcactccaaaggaaacagcaattcattcttattggaattaatactttggctaatgtatttactttagcctcctaatacatcctaatacaagcaccatcatctgaaggcataaagaatgccagctttaaccacatggagacccgcatcacacggcctcaaagggactaatatgaaggaggtgtagcaatgggtacgtagtgataggactgattcactggcctcaccatataccatgtcacctcaagtagctggcctcatacaatttaatggcctgttgaagacccaggcacagtgctggcttaaggacagcttcttggaaggttgaagtattgtccatcaggatgcagtgtgtgcattcaatggctggtatctgtttctgtgtccccaataactagaatgcagaggctcaggcagcaggaggtaaaagtgagactgacccctgtctctgctacttttagtgacctactgcctgaatttgtttcctactttagactccactggattagaaattctggttctggcagtggggctgggggaagaatgtgcctgctaggagacaactgagggccccactgacctatcacctggttgttttgggcctctcatgcccatggaccagcaggcaaataaaagagttagaatgttgcccctggtgtactcgatcctctttaccatgagaacacccaggttgctgctgctcagtgaaactcagaggatttgctggaacatctggtgactccacactcattgataactttcgactattgtcggtttgtagacaaatcccaaatctgtcctctccaaaatgtcagcaccaaaatggctctatcttatcctgatcagagatgcttatggttcatatgaaaaatacagatggcattttatatattaaaacttgtatttttatctgtattcatttttggttcttttttctccaaactatatatttgctaacataaaaataaaattgaattgagagactgaggatttgacagtaggaaggccttactctaaatgatattccagctgcttccaccatagagttttaaagcattatcttaaagtgtttagataaaaaattttccacttgaaaaaaatacctctaggtttatatgataaaaacaccaacaaatatattaagcatggtataagatgccctctttgatctgactgttgttcccacactaggcatctctcaaggatctccccatttggcacttcatgccaccccgccaaaatgataccaccaaatatactatattgcttcttatgtctgtgcctagaaagttctctctgatgtcatgttccaccctctaccccaacccccaccccatttggtctgtctgtgctgagcccattataaaattgcaagtttgtctttctctttagaattctacttatccagagaaaggactatgcattaaaaactattttgcaaccatagcatatggcacagtggttggaacacaggaggtatcaatgaatgaattacttgtgcagttaagacattataattctttttgctttatttatctctataatggaatgggagaaaatgaatgattgtaaatatttcttagcagtcaaagtttatctgggggaatgcagaggcctcgttagtcccttttagagaggtagaaagttgtagaattaagtttatggtaaaaggatttcatggaagcattgtaattttgtcactgatttgaattgctatgcacctattaataatttacattcaatttcagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggtaaaccctaccttttttgttcctttgaaagcctcctggaaagcttttcctgaagtgtttgttctgtaatttctttgcagcttttgattgaagtgtcgcttcccattattatttacaactgtaactgatacattagaatttgcttcaaacatgtctgctgtaaaacctttatcaggtagagttagtttcttcatcactttattttgtacagaactttatcatgacatttttgcgttggattttaagtgatttcctatggatctgtctcctatgatagattgggactggggccatgtctaaccccagcatactgcatatgtcaaaacatgtttgtttaattaataagaaaggagaaattgttttttcactttaaattttgaattaaattttgtagagcatggctcagttattcctattccttttataactttttttggattaattgcttgtgctggactcctaaggcccattatgaatctattttctaaaatactgttcctgagcacgtcaggctctccttaggcagacgctagccacagatacattgcccttgcttcttatcctatcacatctcatcatagaacatgcagtttcttaattgggaagtctctacctgttgttggtaataccacggtctttggtacaaaaaatatatgatattatattgataaatcaacgtatcatatatgatgtaatactgatgcatgtataggctactgtcagaaaatgctactgctcagcacctgccttagtctgttgggactgctataacaacataccttacactgggtaacttataaacaacagaaagttattgctcgcagttttggaggctgggacgtctgagagcagggtgcctgtagattctgtgtctggtgagggcttactctgcttcaaagatatggtgccttctcaatatgccctcctcacggtggaaggggcaaacaaactccctcaacactaattccattcatgagggctctatcctcaagccctcatcacctcctgaaaaccccatcttttaataccatcactttggggattagattttaacataggaatttgggggacaggaggataagacattcagactatagcagcatccattatttttaaggaattaatctattcagacttctctttctctttatatgtctatatacacacatatgcacacacacatacaatgttttaatgttttaatttatgcagaaataagtcgtaagtggtaacttcatttaaatataatttagttgccttttgaattttcttctagtaagtaatttctaaatgcctcattgcttagtgcctctggatatttatatttttaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggtaacctgctccttttgcaagaaaaatcctctcttctctgggtgtacttagttttgttaagaacttcttaaggcactttttgcaaatgacggaagtagaatgccttcagacctcctaatttctaaactctttaacttgtatgctactgttttgagagacattgtttatgagagaaaatataaagatcagtttccaaacttcaataatatgttttgaaaagtttttgcaggattatttaaaatggaacaaagtatttctgttcatagctatcaaatttctttaatttaataattatcctatggtgatttgttaacacctaagtaattgaaatactttgtaatttatattttattaagcttcaagaagtgaagctatcactctatattaatttctttttgtcttatgcttaatagtgacaattttctcgattggggaactatcacagatgtctgtcctagtaaattgagaatgttttctgtattggaaaataatatttcttctatgggaatgaatcaagaacatctgttaaaaggtttgggtagaaatcttgagaggcttttcacctttagttttcatagttaggttttgtttgtttgttgatttgtttatttttaagtgttgcaactcctttaaggtgccatttaacctgttctactatatgttctagaatgatttctggagagtctaaaaaaatatgagtaaaagttagaaaatatgtattttaaaactgtatcagtattcctgctattgatgctgctgtgggaagaaaagctttctttgagtaaagacttggaaaattaacaatttaactttcattattctgaaagcttatgaacatattctgtatcaaaagcatgttagttaaatctttgctaaaatattttctaaataaagtccctcagaattttggcctggtgatcaaaataattgtgtaagatcgctttaattgaataagaaattcttgcacagttcattgggacaatgccctggcccctttgtctccactaggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccaggtaatttactcagtccttttgaagttgtatttgcacttgtaaaacagacataatccttctctggaagggatatacactgtacctggaacatagtgactcacgcctgtaatcctagcactttgggaggcaaaggcgagaggattgcttgaggccaccagcatgggcaacgtcgcaagtcactttctctacaaaaaaagaaaaaacagattagctgggtgtggtggtgcagctactctggatgctgaggcaggaggattgcttgagcctacgagttcaaggctatagtgagctatgatcccaccactgcactccagccttggtgacattgtgagactctgtctctaaaataaaaaaagaaaaaagaaaaataaaaaaagaaaagaaaagaaagaaagaaaaaagaaataatctactttatctaattaattggagaatatttatttagaatttacattgaacattattcatacacactgaagtgttttcaatgttgtattttacttgtcttcttagcatttataataatttgggatataacaaacattctgattttacaaatttgtgtacagaatgattgtaatctattcatatacagaatgattgtaatctaatggatcagtcttttatatttcagaatgttgctggcacattagaatttcaaccaggagaaagatataaatacattttcataaacatcactgataattctattcctgaactggaaaaatcttttaaagttgagttgttaaacttggaaggaggaggtaaggctggtgattcaaaaatgttaaatatttgcttgtctacccatgctgatgaaagtagattcctttagggaagtaagttcctttgaattaatcttacttaaataaatgaataaattattagtttttgaagagagcagcctgaaagttaataattgcttaagatacatgataatatataccataatatatgtggtaatataatctatatcaatcatttttgattgataatccctttcttggtaaaaagaaaattttcctctttacataaacttttagaattagttttagaaattaatattcaactcatagtttcacattgatatgctttcgctatgaggtttggttaattctgagtaatatctctgtttattatatggacagcatgttcgtgctatttttcccccttattattacccactgatatttttctagaagagacgtgcttttagagtgaaaagtataagtgtactaagtcaccaaattacagttttcattcatggtaggttcccctaaggtcacctctctcttttctgttttttgctgtagctctgctagatctatctacagatataacgctgtaaaatctggtccttttggatgatctataatgagttgattattaataaaagaagtcaacaataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtcaagtagcttatagagcttaattctttggagagtcaaggacttatttcatgctttttgactataaaactgatgaaactgatgattctacataaggtagccacaacctgaatagatgtcttacgctagccaaagtatatatggtgttgaacttcttttttatgacttctggataatgtgggagcaaagccatgtaccagatatttgctgcaaatccattttgccttttggatctgtatgatgatttcaggttctgggtgccatacattctcatgtctggtatattcccatcctattgacaggcaaaaacacagggcaaaaggagaagagagggcagatcttacactagcatgtcaatcaaggatattggtagaagcgtatacgtatggatgtggctttgctatttttactctcctttttttctattgctgtcatcactgcccttcctatcttctttgtttgcaaacatttggtaaaataatggttggggtacaagatgtattagagggaaaggtataaccactttctctttattattgccaaagtactttatattttatattttgatgatattatttattttccattattttatttgatctttataactcttagtccatttcgtgctgctataacagaataccacatactgggcaatttataagcaatagaagtttatgtggctcatggttctcgaggctggaaagtccaagactgggggactgcatcttttagggcattctagatacataataacgtagtggaaggctccacatggtcagagaatgcatgtgagagggcaagagagggctgaacttgcttttacaagaaacccattcttgcaataatgaacccactcccaggataacaacattaatttattcatgagggcagaggtgtcatgacctgatcaccccttacaggtcccaattctcaacacggttgcatttgcgattaaatttcccacatgtgaactttggggaacacattcaacccatagcaacaacatttctataataaaagacagcatctttcataggtgaggaaactgagataccaagaagtttagtgacttgctgaaatttttacagctggcatctttcacaaccaggaaagcagaattgttaggtgacttgtctaggactctttccacaatgccagtggccagagggtgatcaagtttgagaatggtaaataaatgtggtggggatttgaatgtgtggatggaaggaaaggttagatgcatttctcaatattgaactggttgttgtgaatggtaaggtgattatcacaggcatattaggcctaagtgtatgattatataatcagataaatatattttaaatatctaagatattagaaaataatttacgttggtgtaaaaaaatgaaaatttaaaaataatactagattgacagaattgggaagtaacagttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggttgatggaagtggtagtggtgatggggacatggaattcttccttccaactattcacaaacgtggtaagcagtttttccaaggtcctttactattataggtttttattttaacttctcattttagagacaatactaaccacttattgacacctactatgtgtaggtcctttacatattttatcttattaactgtcacagaaactttatgaagtatgatttccttcatgttgtagtcacccagctagtaagggatcaagtcagaatcacatccctttctgcttccaaaacccagactctccttcttgtatgaacctaatgtagtttcctgattctaattgtgatagaaatttcacttgaatgtcatttataaaaatggttgtttggaaacattttacatagctttgaatacataaaaagaggtcaatagaaaatttgtattttcgttttaaatacatcacacttattctctgtacaaaaaagaactatgaatccttatatgtaaaatgtaatcaaaacaaatggggagtaatcccagcactctgggagaccgaggcgggctgatcacctgagctcaggagttccagaccagcctgaccaacatagtaaaaccccgtttctactaaaaatacaaaaattagccaagcgtggtggcatgtgcctgtaataccagctattcaggaggctgaggcaagagcccaggaggctcttgaacccaggaggcggaggttgagtgaaccaagattgcgtcactgcactccagactgggtgacagagcaagactctgtatcaaagaaaaaaaaaaaagaaagaaacaaatgggaaaaataaataaggaagaaaataaatggaaggatagttggcaattattgaaggtgatattgaaaagaggatgccttttgaagtagatttatatacaaacatgattcagctttttacctcaaatatttttttcatatatgaaaagcatacttagaatatttgtttcttgaagaagagcattttctaatcctcaaatccttcttttttcacaatgtcagattttatattttagtgtcagaactcatgatttcactgccttcattcctaacttccatcagtgcctaatgcaacctctgtagttaattacactattacttttagaattgttcattttctagtctgtagacattaatgcaacataaaatttgaacatactttttaggaaaaacttaaatgctgctttagatcatggcatctttttagctacagaatgggactatttaagatcaggagagatagatttatagtatcatcacatgatgaaaaaataggcctaggattcatgcacgttggaaaccaagaatctgttccgccagaatgggaaactacttattatttcatgaaggtaagagtcattttggctcaagttcttttgaggtcagaaaggtcgtgggagaccttcctcatatactctgtgtggaagaatgttctctttcatagagaagaaaaagaaaaacaagttttccttattcatctccaagtgcttatgcagcacttgtacatcacgttggtgccaaagtagagaaaggtcataaaagcatgaatatgtgtggcacccatttgtgtctgcctttctttctaaaacaaattagaatgtactcaatgaatggaaggactcttttcaaaaagttgttccttggctttttctttgatttgtaaattactgatcatcattttttttttctatttgttggaacttgttcatgcagccagtctaggagtggcttcccaaattctagtgacaattgcagcctctgaccacgctcatggcgtatttgaatttagccctgagtcactctttgtcagtggaactgaaccagaagatgggtatagcactgttacattaaatgtgagtaccttttcttccttcattcctagacactttctgttgttttaaaaactgtactgtgctatgaaagtgtgttttatgctttcctttttttgtgtaggctgaggggaatgagcctattggcacaggcaatacaaattggtgatcaaacagtcgtttggcatttatttttgtctttagtattgcacatggagtcattgtttaattctgaagatccttgaccctttaaggaacataatggagctgtactacaagtatttatcttacatagatttttgtgtttgttcagataggctgtggtaacaaacatctctaaaatatcaatggctagtacaacaaagaattgccttcctccctccctccctccctcactccgtccctccctcccttccttctttccttccttccttcctttctttctttcttttttcgagacggagtttcgctcttgttgcccagtggagtgcaatggcgtgatctcagctcaccacaacctccgcctcctgggttcaagcgattctcctgcttcagccttccaagtagctgggattacaggcatgcaccaccacgcccggctaattttgtatttttagtagagacggggtttctccatgttggtcagtctggtctcaaactcccaacctcaggtgatccacccgccttggcctctcaaagtgctggaaaagatttgtttttcattcgtagtatgtatatgtccaacttaagttagcaaggggctctgattattagtcactttaggcaccaaggctatatctcagcaggtgcttttatcttcttggcggagggaaatgtggatgtgaagaacagcataccagctcttatagcttctttctggaagtgatttacatcatttctacttaacttccttgatcaaagcaggtctcctggctgtgcctaatgtcagtgggtgaagtgcaatcctatcctgtctctctcccataaggaaagaaaatctaaaacatgggtgaactggcaataacaataactctatatgatgtgtgtgtttgtgtacctactctgctttgttccagtagaaattaggaaggattcattgttcagtgactcacaggagctagctgcttgctcagcttccatacgaataatgaagaaatatcactcaaacatatccttctgtactattatggcagattttcaataaactgttgtgcgataaattcaacaccttagaaaggataactaatgactcaggaaagataaaaaaagcgttaagggaaaggatcaacttttataaaattactgtctctaaattttattttgatgtaaccatcatatttcaagaataaataaaaattactcttagttgggatttacttggagaaatttttaaacttttcattcttaacatattattgacaaaagcatatcttccttcttaaatgtattttcttatactttgggtcaaatatgttttttgatgagtttgtttacataaaatattgaagataaaagtaaatgtgatttgttttaaaatgagttttacagatcacttttcagaaaaacaccatttatacattccttgcaatgaaatatataccatttttgcagtgagtgtgaaaattttatgagtgtgcctgaatgtaatatgttgttaatcacatttaatttattgggcataaaagatacacaaaaaatagttataatttaaatagaagctacgtttttttcatcaatttatagtttcatgcaacaatcgcctttgaaatttcaattgtgttttatttattttttttaagagatagagtcttggtgtgttgcccaggctggagtgcagtgacaccatcatagctgactgcagcctcgaagtcctgggctccagggacccttctgtctcagtctcctgaataactgggactacaggcatgtgccactgcactcggcatagtcactttttaaatatcctctatttgtaagactctctgtgggccttcaaagatggatagtatatgacccctgcctgcagcagtcttgtagtctggagaagaacttatataaaataaaattgtgctgctatcattaatgtatttataagcctctaagtaactggctttaatctctcttttaatagattttaatattaagtattttgtaggttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaagtaagtatcccttagtgtgttattattattattagctctcagaatcctgaaacaatcagttttaaattttatttaatagaaaattctataaaaagtagtaaactctaactttgaaaatgtcctcttacaacagtttacctgtaaggtaactggaagccagacacatttttttcttagaaattatgttttaaaagtcagtagaaagtaagatgggaactttaaaattatctagcacactctattataacaaggttggtgtagtcttgaggctgcctctgatttctggatgagtggattcatccactggggttgctgtaacaaactgccataaactgggtggcttagaaacaacagacatttttcctcatagttctggaggctgggaagtgccacgattaaggtgccagcagattcagtgcctggtgagggtctgcttcctgggccttgtggagggttgaggggtctctgtctctctcaggcctcttttacatggggactaaccccatttacaagcgtctcacctccttaacctaagggctccacctcttaatactatcaccactgggattaggatttaaatgtatgaattttgaggcaggagaacacaaaccttcagaccatagtaacacagtagttcagtgacagtattaattaagaatgggccgtgcagaacaggtttgtcagggaagaaggcgaagcggttaaagaggcagtaatttagagtatgatgatttgcagctagtttttgaggtcaaggaactaaattagtttcctactcaatcttgtaactgaaatgcagttttgttttaatggcacagtgaactaattagaagagcatcattctgttgtaatattatgtaaagtgatgattaattatactctaatgattttttcctttttgataacttttcaacacatattaaaatatttctgtaggtaactgttcttttgttataaattctataataaaaatttctctagaatgtaagctacactagagcagggacattctgtttagtttatttttgaatcccgaatgtctagattaatgctggtgcatattaaacaatacatattcttaaatattcttaaatataaatagtagggctgggcgcggtggcttatgcctgtaatcctagcactttgggaggccgaggcaggcagattgcctgagctcaggagttcaagaccagcctgggcaacatggtgaaaccccatctctactaaaatataaaagaaattagccgggcatggcagcacgtgcctgtagtcccagctactctggaggctgaggcaggagaattgcttgaactcaggaagcggaggttgtggtgagccaagatggcgccactacactccaacactccagcactccagcctgcgtggtagagagtccatctctataaataaataaataaataaataaataaataaataaataaataaaataaatagtagagggaaaaccccaaatgagaatcctatttggctgatggaatcttgctgaggtttcttgatgacttttggccagttcttagaattttgatagctttctgtgttctgtgtggatcttctgtctttcagttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtaagaaaagacatctaaaaagcagtacatacagagggatgtaagcacagagggacatgtatccttgattaacacagcctctcaaagttgcaattaggataatcaactagaaaactagaaatactcttgtatctttttcaagggacaaatctagagtctttttttttggggggggggatggagtctcgcttgattttacaatttttttatttttatttttattttattattattatactttaagttttagggtacatgtgcacaacgtgcaggttagttacatatgtatacatgtgccatgctggtgtgctgcacccattaactcatcatttggcattaggtatatctcctaaagctatccctccccgctccccacaccccacaacagtccccagagtgtgatgttcccctttctgtgtccatgtgttctcattgttcacttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaatagtgccgcaataaacatacgtgtgcatgtgtctttatagctgcatgatttatagtcctttgggtatatactcagtaatgggatggctgggtcagatggtatttctagttctagatccctgaggaatcgccacgctgacttccacaatggttgaactagtttacagtcccaccaacagtgtaaaagtgttcctatttctccacatcctctccagcacctgttgtttcctgactttttaatggctgccattctaactggtgtgagatggtatctcattgtggttttgatttgcatttctctgacggccagtgatgatgagcatttcttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaattttctcacattttgtaagttgcctgttcactgtgatggtacttacttttgctgtgcagaagctctttagtttaattagatcccatttgtcaattttggcttttgttgccattgcttttggtgttttagacatgaagtccttgcccatgcctatgtcctgaatggtaatgcctaggctttcttctagggtttttatggttttaggtctaacgtttaagtctttaatccatcttgaattaattgttgtataaggtgtaaggaagggatccagtttcagctttctacatatggctagtcagtttttctgaatgggcaaaaactggaagcattccctttgaaaactggcacaagacagggatgccctctctcaccactcgtattcaacatagtgttggaagttctggccagggcaattaggcaggagaatgacataaagggtattcagttaggaaaagaggaagtcaaattgtccctgtttgcagatgacatgattgtatatctagaaaatcccattgtctcagcgcaaaatctccttaagctgataagcaacttcagcaaagtctcaggatacaaaatcaatgtacagaagtcacaagcactcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaggatacaaacaagtggaagaacattccatgctcatgggtaggaagaatcaatatcgtgaaaatggccatactgctcaaggtaatttatagattcaatgccatccccatcaagctaccaatgacttcacagaattggaaaaaactactttaaagttcatatggaaccaaaaaagagcccgcatcgccgagtcaatcctaagccaaaagaacaaagctggaggcatcacgctacctgacctcaaactatactacaaggctacagtaaccaaaacagcatggtactggtaccaaaacagagatatagatcaatggaacagaacagagccctcagaaataacgccgcatatctacaactatctgatctttgacaaacctgagaaaaacagcaatggggaaaggattccctatttaataaatggtgctgggaaaactggctagccatatgttgattttacaattttgttttgttttgttttgagatggagtcttgctctgtcacccagggtggagtgcagtggtgtgatcttggctcactgcaatgtccgcctcccgggttcaagattctcctgcctcagccttccgggtagctgggactacaagcgtgtgccaccatgcccagctaatttttgtattttttagtagagatgggattttaccatgttggccaggatggtctcgatctcttgacctcatgatccgcccaccttggcctcccaaagtgctggtagagtttttatatatttatggcactgagcttgtagactttgcaaaaagttttggccaaattatctatgaatttgaaagctatgatgaccaaaatatgcacaaatcaatgaaaagtaaactgaggaaaacactggttttctctgagtgtactcctcatttttgaaagggattcacttgtaaatgactactgaggaatgcagggaaaatgggcagctacatgctttcagtgcttggcaacagtcttgtctctggatccctttatcttcttgcttatttatttgtgaagagcaaggaagaggcaacagttagtattaactattttatatataagaaaatgacttcattgccagatgtatatataagaagactgcctactttgatagtgccgtcccagcatccagagggagatttgcctgagaactattcaattcgaatctttctagtgtgctttcagaggaacaggaatgtgaatggatgggatactgtgcttgatttaaaaaaataaatcatctggccataatacttgcttgaaaagacaataaaccaggcccatctaatacctaactggtgtaggctggggtagctcctaggaatacctggctgcctgtagagggcctcacacactgacagatggtggggattggttagtgtactaagacattagtcctcagtcttcacatgaagcacccctcctttccccacccacctttttttttttttttttttttttctctcctgccatcctgagcagtactcagtagcggctttcaatctatgcaagaaagtcttttcatgtccagctgtatcattgatgatgctagcgttcccatatctgtgcagtggtataatttatctttccagtggcattacaattctatttctgttcttttttctaaaagtacacatttttttcttgtagttaagggggcctatcttgtaatgaatgattctctatttatataaatagaccaaatagatatacatctttctgaaagtgaaggaatgaacttgagcacccctaggaagtctttttcgttattttgtgacattatcaaacccatttttctactgagaggcataaaagtcttcttgcttagaataaatgtagtcaatatcctcaaaaaagtatttccaagtagatccataaagtttgttacctgatagtttttccctagtatatggaatgttttgatcatattttagaagtcttaacattttacttttggtcttttcaggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggtatgaagactaatttatgtctctctttgacttgtctgcatgtatagatcatagataatgatctttacttttggagactcagaattgatctgatcatgctttctttcttaacctgctgttactgacatataggacatctgtacacagttattggcagttgttagtgattgtttaaaaaagaaattaaatcaatctcttagcatatgtggagaagtcacgaactattggctttagggtgtgacctggctcctatatgtgttttgtgagtcttaggcaattctttagaaaaataatttaatttatagaaatttacacaaaaatttggatttctgggctttcttgataaataggaaatgtggcaatatcaagttccctttcctgcataacatcagtcatgggaaccaaatagcaactgcccctctggagcaggcttgcactgtgcaatcagcttctgtgctcactggacctgtcactcatgtctggtatagacttgagccctatgggctttgtggtttctacttctatcacagtgaaaaataatttggaaattttggcagagcagaccaatttgtatcacagcatgttactctggtttttgtgggttatagctacttagattgcttaggggggaagagaatccactataggatggtgcttggttaactgttatctctgtttcactttgtatttgaaatgaactctgctctgtctacccttcaggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggtgagaggactggctagtatagaatgacactgtaaatcataccgtatctatagtgactagaacagatggccattgtaacattttggagaggatgtcaaataaattattcctgcaagaatgttcaaactatgctagtgtgaaagtgatccttacagttgacaaaagcaggaatattctagaaatagattgtatacatatgccagtttactactataagacttttttgtacaattaacttgcattgttcaacattttggttaaaaggttaaatacatatatatatatgtatatacacatatatagtcttaatttataatacatttgctctgtataaacttttttctttttttttttttttttgagatggagttttacgcttgtcgcccaggctggagggcagtggcatgatcttggctcactgcaacctatgcttcctgggtttaagggattctcctgcctcagccttccgagtagctgggattacaggcacatgccaccatgcctggctaatttttgtatttttaatagaaacggagtttcacagtgttggctaggctggtctcgaactcctgacctcaggtgatccacctgcctcagcctcccaaagtgctgggattacaagcatgagccaacgtgcccagcctgttctgtataaactcttaacttatatttatactcccttttggcttgggtgtgagccagtcaatcttaagtattattgtggtttttcattcattcattcattcattcacttattcttcaaccattgttgagaacttactatatgaaaaatagcatgcgagatgcatcttcttgatatttccttttcctgatgaagcagcaaggtagcaaatataagtacagtatcagtggaaaagttaatcactaacatacattggctgaagataattttattgtatgaaattcaagtattaacatttagatctcataaaattacttttgatagcatttattctttaatagtataaaattttatacaagttcataaaatttattttgaatgctaattgtgccatttttcacttctaaaatattagatattcattagcacataaaaaacatttctgtttttttctctctaaatttaggtggcattacagtatgtttttgttttaaattttgtcaaataattttatttaagataatgtgggaaataaagcatagtatattaacgctccattaaaatgtatatttcagattttttttaaaaaagttataggacgtaaaagtactattattgaaatggtaaacataaacagggatattaaaattgagtcacatgattatataacaatattaaggagtttaaacagcctgtatgtcttatatataactaggttctgttattaaatgttgatgatgggttattctgttacatgctgggtttgtaagtgtaattggggagttcttttagtccatttatatttcattccattttgttcttgtacttgtatgtatatgtttgatttttttcccttgaatcatttttattctaatttcagaactgtgatgctgttaaggaagttttcactgtatttttaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaaggtatatgagatagctacttgcctctgtgggagtgatgagaattgtggggtggtggggaaggatcccttgcacagttaaatcatttaggttttgtggttttttctatgccataaattattttataggttattttaatgtgttaactgaattatgcttattagtataaagggcctttcatttatcatacctattgttagtgaaatgggtaataaattttacatcactgagctctctaaccccagaaatgcattgctctaatctgtaatttgttacaattagtacttaaatataactggcttttaaattaaagagcatttgtatgatgtatgaaggagctgatttccaggtctgttttttttttctttttttgtgaggcagcattgggctcactgagctccttcagaaatagaaaacaggatcttgggaacttgtgacaagtccctggtatccacagggaattgattgcaggtccttggatataacaaaatccttggatgctcccctttaatataaagtggtgtaaaatataatatttgcatataacctatgcacagtcatccatatactttaaatcatctctagattacttataatacctaatacaatgtaaatgctatataaatagttgctatactggactggtttttaaagtttgtattttttaaatttttttttttctgaatatttttgatctgcggtcttgaatccacagatgtagaacctgtggatagggagggctgactgttactacatttcctcaaaatgtagtcatgtttgttatcattgttactttgtttcagttaagtaaagcaataaaaattaactttgtaattttgttttgaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttgttaatatacagaaatgtagtttggctttagaaaaaaatagaagttaattggcttgttaatggttgacatgacatacatagactgacatgactgtacatatatatctttttagtttaaaaaatagattttccgggaatatgtgaattttatccctttatgtttgatagtagtgtctttgacaaagcacagaggaaactataaggcaagttctaattttgtaagggaaattttaataatgacccatgtacttacaaccatacatgttggtaagaagcagtggtagctaggaaaatgagtattaattgataaacattttcatatgcactagacaaatcaggaaatatcatcagagaaaattatttgtaagtaaaagtagcataaactttggtgactgcatttatattacattaatcctaatgataaatttataatactgttcctacacttgagatcactattgtaaaatttcataaacaatatactgatattttacatgatcagctaattagaattaggatcagattgagtggttctttttcaggactggttgactcgtgtgctatttaaaattgggaaagttagtatgtttaaaatagttttctctgggtgtgggacaggtatctttattgagattattgattacatcctcatttgggcagttatatattccacaaaattttaaaaaacatagtgcttttctggttgaaaaagtaatgtatactctaaaaacctcaaaatatacaacaaaatgcaggaaagaaactttgttcctaattctatattttagaacaatccattgtatttgttgtttaactttttaaggcatatacttttttttggaaactaattagaggtcatggtacatatgtaatacgctttttgaaacacataataatcattatgttttagagtaaattttaaaaattgtataaaatatttttattatggttattttctagtcagtgatttgaggatttagtgggatatgatatgcttgacggaagatgggaacaggttagtaattggtaacttttctatttcaaaaggaataatgaaaatgtgacgaggagggagtggaaatgaaaatataaagttggatttttccagtggttatgttaactacaaagaaagttatatataaagaaatagcattatataaattaccattaccatgaattataaccttagcatcacacaaaatggactctattgctaacttagattcttagataatgcagactctcttaaagcaatcttgacactgctgtattgatgaaaatgcagcagggtcacaaaagagagaacatgcatttaatctcctttctccttttccctgccttttcttttcccactccttcattgtctctccagaaagtggggagaaaataaataggggacaccttaggctgaatggcagaaagtattggatttagggacattctgtggtgccctatctactagatcaaattgcaaagtagattgcttggacttttgttgctgtcacttgtccctttgagttcctcttttgttttcttccttcattgcactacttcctggagactggtacttgatgctgtcatctcatcgagttactcaaagatgcatctcatttaggctggttcttttgctcagaatttgacatccctttttagttcctcattttgaccacgattccctaagtgttcctggtttttcaggaaggtattgtgttgatatctgattaaaattatcacagtaatgccagaatgagaatgagactccactttcctaaagggagttgtttctaaacaggatatctttggagctcttttcctagctaggtcactgttcttggctaacaaccaggaagtaaagccatgattctttgaaacaattctaccttttaactttcccataattcaaaatgtccttctccacaatctgtcttcattaatgaaattttacagtgtttgatatgtgaaaagatatatatatatataattaaaatttgcttatgttgcccatgatatggaactgttataattcactcatatttttatttaacttttaaacatagaaattattttgggcctttctgagttctctgtgttggtgattttgttactttggtttttattccattgatgtttttataggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggtgggttcctttttttgttaagcatattcattttcttttctatggatgttgtcttttgtctagttctttaaaacttgatagtttttccctttcattattttgttgaactgtgtgtgtgttaatctgcatagaacttctttgggagaaggctttataatgaactgtttagccagatttaggagccttgcaaaccaataccatgttctagcttgccattctctactggtatgattttaaggaagttaaacctgaaatgcttagttttcccatttgttaaatgattcaaaatattacttcataggtttctttgtgaggattaaatgagctaataaaggtaaagtgcttagcatagttcctggcaagtatagcgtatgcccaagggtagctgttggtatcaaacagtgaaacattggtaaccggttaaaaacaagtaatagtttgtaatcagtgaatattttagcctggattttatattgtgtttgtacattttatgaacaaagtgccaaaccttataaaatttctttttttccttaaaaaacagtaattttcttgaattcttacttaatattttacatcatatgtagggttttgcatagatgggctaatttttgtgtgtttaaaacataacagtgtttttgtcttcgagtaagcctgttttggggtaaataggtattggtagcctgtgtttcattacatagtttatctggaattaaaaaaataattttaccttgaatagttaataaatgaaaaggatatagattgtgtacttggacatctatttaatagatgagaaaacaaattgagacatagagagattaaaagacttgacagtgtcagatggttagtggctgtgccagaaacagaatgtattttactgtattaccttttcccttactgtacttccaacttgcaagtttatttatccatgcaaatattcgagccattttcagtactctacttttattaacggtttggaattgcatgttgtcatagcagtaatgagtaaaagtgaataattccataaatctaacctaaagacagatcatcaactatcaaaaagttatttgtaacataatacagagttactgcaggaatagttaataataatgacaacagtaacacttacggagtgttttctgtgtggcagacactccaccttcattatttcacttaagtttaacagcagtcctatgatataggtataattgtatacaccagattttcatacaaggaaactgaatttgagagagactaaatagcaacaattattcagtggtagtgcttatgcccagctgtgtcaaatccaaagcccatgctatatagggcacctagtgaggagagactttgttttgcttgaactcacgtctgctgcagaacctggcaatgcagggacttttggtaaatatttgaagttatttgagttggaagcataatgaatttgagtagcagtgcctgtgtgagggaaggaaattagtgagagaacctgactctgtttcaggttaaagatggacattggttaaagatgatagctgaaatctggaaaatgaatatgatgacttttgtggacagaggaaaaaaaagcaaattatcggaatggaaccatgaagaacatcagactaaggtgctgggaaagaaaaaattacctgagaggagagagaagcctttgctggagaggcagggagaaaccagggagagagtgtgttttcaatcagttacactgattactccgtaatcagtgagtaatcagtaatcagtgtgtctcatactaacatggccaaaaaggggagttagatctcaaatgggccaaataaaacagtggcaatggtagatgaattttaaaggagtattggggataggaagcaaatatctaaggatgacaaacatagaggtcttcaggggttcctcctcaatgtggctttcaggaggctgcctgttcagtgtttgcttctggtctgtgacaagaggattggaaactcttttaacaatttcactttgctgtgatatccaaaagcagtatctatgggctggtattttgtatgtcttttttgtttgcgttagttttttgctatttaacttatctagtcatttattttattctgttttataagagggtcagcctctaatggattaaggcaaacaaaacaaaacacaaatccctgtccttcacagcatgaagttttgagaagcactgcttattggctataacagcaaggagaggagaagcattggatagaacagatgacgggagcattttggatttgttttgttgaagaaatagggggaaggaaaagagaatcaaagtattagtggtatggaaggtacaaacaagagctgagatcaggaaaggatagacgagatttaaggagggacttagagctatactaggcatgcacttttcagcagtgtgatgaaatttcttttctaaggaatacaaaacaatttggatgtctaggatcaatttaatgaattttaactgtagggccactaatgttgtgaaagtgcatcctatgagcctggatggtggtgctagtggtgagttggagggctctgaagacacggaggccctcctgctgggtaccacaacatcttggagaaactgcagatatgaacacctacagtctgtttggcccagatgaacttcacctgaaaacaatattgtagcctcgtcagtttccaacagctaattatctgcaggagaggcaaagaggaaagattattaattaaaataaatggtccaaaggtgttattggttaaaaatctgctttagcatatcaatctaaaacaccaaattgcttttcttgctggcatgagtgctccctagattttttatgttttctacataaaagttggagtcaatttctattttttacttacttttttctcttcattcctaagccttttcctagattataaattatttttttcaaaaacatattaagccacaatagttcagtattttgtgtatgctttatattaccatgaaaattgcacagagaaatgtgtatcatgatgattttatgaaagtgaattaatgaaaacatcatggtgattcttcagagataaccgctaaacaaatggggtgaaaataattgtgccatgtgagcttttaacagtgttaacgttgcttttagcctagtgttggagtttcatttatgtgattagatttaaaatgtggactatgctgaacttctggctctagaatgcatttttgattcatgggaggaattgccttagtctctaacaatgtattgaattctgtagaatcctatttctacattttgtcctaatgcagttggagagctgcccagtggtaaatattactttctttcaaatgtaatggacagaatttagaaatatgggacaatggattttactgtggttgcacactgggtataaatgtgctctttataaatctgtgctaggtgtttctctcagtcacccagctgagcagcagcataatcatcatgtcatgttcgatggattttaaattttttcttctcttagggacagcgtgaatcttttttacacaaagatttgagcaagaaatgtgattctttaaagaaatatatagaaccgctctactggaaacactcaactttttcttaactgttctttttgacagtctgcttcacattattcatattcctataattgttttatcccgttttcttttttgttatagagggcaatttggatagtatatgtatgtcatgtatacacgaatctattaaatatattttctgtattttggttttccattagttttatgtacattgtagttggtgtttatctttgtaaaaagaattctggtcttgaaaataagtgtctaaaacacttaggtttattaaaatgcattcttcattcatattctttatctgcattaggttagtcctagacaccatgtaacagatctgctttagagttgaaatatgtcactaacttttggtaaactctggatttcgtatcaagatgatcgtccagttatgtagtcagacactttgttatgtaagggttgttctgcctttcatcttgggcaaaaactagaaggctgtttagtacctagtaaagtctttgtcatctaaaaataacatactctctcttaagacttttcttctgtcttttcccttaaatttggaaggctaagcacttatttttaagtttttcattttcctgtgactgtttgacttttcatcctggcagaaggtatctttctgatatgtccagtcattttttccaggaggcattttaaatggacctggctcctgggagtctgcaataaagagacagaataaatacctcccttttgattattgcttagaaaaaatttcacactattcttgctgttgacatgatacattttcactaggcttacaagattatgtgtttaagaaatatttcatttatcttttatttatatgtgcttctctatgtgcgtgtgtgtgcgcatgtgtttgtgtatatgtgtgtgtgtatcatacttcaaattatatttttgcagtattttcttgcaagttactttcatagtaactttttaaattttcagaggggatattgatgaactagtattagacttttagtgtttttacatgtagtaagtttgtctgaatattttactttcttttctcctaagcattttatttttacttttacctaaaaatgatgtatttatgcccaaatctctgtgtctaaacttgcaactgcaattttattattgtgattatagattacccttcaacatggaaattttttgacctgcattttgttttcttgccatttgtgttctctttgcactttagtacttcattaaacttccataattttctttttgaaccattaacaaattttgtgatttgaaaagtttgaaaaccatgactcttatgaaagagtcaccagacaacactgtaggtgaaatagcttaataacttcaaagatttttctatgctttttagtaataaatttttgtttttcaatattccaaacttgctctataagaaattctatatattgtacaatagagagacaccagagtttcacagtagtgtctatattttgttcacaagttttacaaatacaaaatttttaaatggtatgctagcaatggctgactatacatagtccttcattttcatcccaatctttggacaatctgatctagaaattcctgtgcttttaaaagataaaactaagacatagtctactaatgtaaaggtaactaattttttttgtattgacacacttaaaatgtgttttaagaagcctttctaatgcttttgtttatattatccactctccttaaaatgttcattttgttaaaattgtgtttaaatttagtatgaaaaattattttgtttttaaattgaaattaagatggtctctaaattaattaattcatgatattttaagaaatcttcctataagaaatatttgtttagttgtcttcagaaataaaaaatgtggcggtttaaaaaatacttgaaaatagtgtttaaagtttattgctttatttctactttttaaaaaatgtttgaagatattacttatatacacaaaagttacttggatagctaactgaactaaaactaactaaaagtgacatttttagtgaatgtttgtggtttttaactatatgtctatgctatacagtttgattaaggatgtcgtcttctaaatctttttaaacatcattctatccttgcataataataattttttagtgatacagttcattggtatttcttagttgtgttcatcatcatataaagctagtgaattgagcatattttcaacaagtcatatggccattagcacgctccctaacagcttactttatgcttttagcaatttgaaagacatgttatgattttcttcacttttgtgaagtattatatggggaaaaaagccaggaatagaagagatctaaaatatctccattatccaggaaggataactgtaactttggcaaagttacagatgttgatgtacagatttgacacctttcctttgtatttctttttataatacaaaatcattgatggtatatgtaagttacaactaaagaaatgtgattttcaggtatttgcaagcatttttatgcatgcattgtgtaaaatcacattgcatatcagtgtaaggatttgtgcccttttgaaaagtgaaggaagaatttacttgtgttactatcatgaggactttattattttctttaatttacagaacacttatgttctggtgcatgttttggagtgtataaaagtttgtgtttcccattttagcatgtgcttttgtaacttttacatattaaatttcctcaagttctactaaattgaagtatttagaagtggggataataaacaataagcatgtataaagattctagaaaattcaaaacaaaacagctttgtaatgttcttgggaaaggtgctgtaatagttgcatgcttgggatttgggttttgttgagttcaaatgtgaagtttattttccattaagtatttatcaatttacacattttacttgcaggagaaattttacaattccatgtgataagaactttccctggtcgaggaaatgttactgttaactggaaaattattgggcaaaatctagaactcaattttgctaactttagcggacaacttttctttcctgaggtaatactgcaaagaaaagtcgatcacaaatatctagaaagaatggtgtattttgaggaaaatgggatagaaaagcagcactattgtagttattatctttctctcttctccagacctacttcgtatgaattctttgatgatgtatttaattgtttttatcttccttctcattgcctcaatattaagccaagccaatattaccctctgccttgagtagtacattggacttttaatgactagtgtccctgcagcacttgtcttcttttctctgctccagttttttctactcaccattgttgtagaaacctctccaactttgtgctttgagatttccaatagtgttacattgctcaataaataagatttatgttcattagctcagcattcaagatcttccacaattagcccctgtctgcttggagcttaggttcccatgtgtcagtggtttttatttatttatttttaagccacagaacttttgtttaaatgaaaatatatttgcctgcacaatttataaggtgaataaaaataaagcaggagatagttcatattcaataacgacagcgggattgatttctttctgtatgacataggggtcgttgaatacaacattgtttgtgcatttgttggatgacaacattcctgaggagaaagaagtataccaagtcattctgtatgatgtcaggacacaaggtaattcagaatttaattttaattttttttggtatattcttttcgtaaaagaaagaaaattgttatctctgtatttaacaattagatgcataccaatttttaaaatgttactttattatgtgtcccctagaaatgttagatcaaaaaaaattagcaccatatgggaatacttatctttatagactaggaaagaagccctgaaacgttttgctaaatggttacttacagaataaaattcatttccgaaggtagaatttttttgaaattaatttgagacttacaagccaatttgaattttggaccaattatatggataaatcaaatttagtctttttttttttgcgacagggtctcactctgtcaccaggctggagtgcagtggcgcgatctcggttcactgcagccgccgcctcccgggttcaagcgattctcctgcctcagtcttccgagtagctgggactacaggcatgcactaccatgcccagctaatttttgtattttagtagagatggggtttcaccatgttggccaggatgatctcaatctcttgatcttgtgatccgcctgtctcgccctcccaaagtgctgggattacaggcgtgagccaccacacccggcccaaattgagtcatttttaagcaaattatctgggtactttcctcagtttctattcaatttctataattctgataaccagtataaccaataatgacagtaatatgtgaagtaaagaaattcatgatcttccacctgaaagaaaaatggaatgtggcttttgttaacctgaagatttgttagagaagtaaatagaacacttttgattaccttaatgtttcagagagtgaggctatgtttccagcgattaaaagctaatgccaaatcactgttagattcctgcctgacatttttaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggtttgtgttactctagaatgaatggggtttccaggcaagtgcttattaatattctacttgtgtggatgaaagccattgctaaaataaatcggggacaggagaaaattaatatttcttcattcaggacagaactttataacttctttatctttgaaaagattaaaggaattatctgttttcacagaaatgctgtgtaattaacaaacataacatttcagcagcatacagtaatttaggctgtctgtgggtctactaatctacactgggcttggccatgggtggctctattccatatgtctgtcattcttctccgggaacaaatggtagcacaaaagaccaagtgaaaatgtgtaaggccccctgaggtctagggttagaaccagcacatcatcatttttaccttgttctattggccaaaacaagtcacatatccaaattcaaagtctagaggcagggaaatatgcttttcccacagtgagacacccatgagccatcacatggtaaagattatggatataggaaggggtgaggaattgggaccaataatactagctactaaaggtgcttttaggaaaggcaaaaaattcacaaggggatattattgtaaacatttagataattataaaacatttttgcaacctattcaattaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggtaaaactcttttttttttttaatcttagggggagatagtttaataagttttttttattatactttaagttttagtgtacaagtgcacaatgtgcaggtttgttacatatatatacatgtgccatgttggtgtgctgcacccattaactcgataactcatatatttttccttattattgtattaaacctgaagtaactacatagaaggtagaaattgatggaagagtctatctataacataagtggtaacatttagtaagacacttctagtaactttgcattttaagacatcaagtttcatgaaaactaagtttacctgagtttttttctattagtaaaaaaaaaaaaaaattactctgactttaatatcaggtttggacactctacaattataataccagaaacctggtgaattctcttctgcttgttccccctgctggtacctttaaatcatcttatttcttttcttgattttgttgttgttgttgttgttttaatcatacaggggtttctgttcttgtttagatagacaggcctgctgttatgtattttattacagacatgtccgtgataaagaattttcttagggcagtcacctttgagatgccatagacctaagaggtttcaaggagtattttgattacttcaaaggattctttggaccagaaaatccgtgtatgtcagaatctttgttggtagtaggaccacttaaattagagatagggagaaactcaccagaggcagatggcacaaaatgcgattatggttacattaagcttagcataatcattaatgattgaaattgcattttaaataatttttcatattgtggaatctcatgttgttttggggacttagtgtatcagttacctaaatacagttccaagaggtttataaaaatggtactcacggagggagtaggagatagtgtgtaggataggggaagggaaagagggagaaagcatgaatattgcagttgagaaaatatttttcaattactatgtattttgggagttctattttaaaatgtattttattatcttggaggcttgtgcttttacagaattataagtggtgtaaaccatctaccaactgaagtcagtaacttattttgttgattactgtggcactgtgacctaatataacagtataaaaattccaaagctgtaaaattaaaggtaatattatgtcagtatatgggatataacacaagatttgataaagctttcaagtaagttatctttcaaatgtatactctattaataacaatataaataaatggattgattattccttagatatgttagtttttaaagcagagaatacacagtcacccttcttttctctgaggagtctagatttttttgaacattgggtttttgtttccacctttatttgatcctagatctttgcaaccttttctgctccctgattagcactaagattaagagactgcaggcctatgcatataggagcaagctgccctggggagtggtagggaggaagtattgcgtggggggtgggggacattaagagtaggcacagcagtccttctatatcactgaccttgtaactcatgttggtccatatattacataagacaatctagagaccatgattttcacttatattttcacatggaaacatgactccattaaataaagtgaggagaaaagcatatgttggtgagtgtgtactgacattatatatgcataaatatacatacacattgtgtttctttgtaaatattgatggctggctgatcactcttgacatggattttgctaatccttatgtttttggtatctgccttgttttcattgctattatgtggactggtgattaataataatagctattaattttaaagcattttctctaggccaccctacacatatgatttgtgatcattattacaatctcccacccaaaaggagctattattgccccgttatagagatagtagaattgggagttctaaaatttaagtaacttacttaaaattatagaatttggtactaggcctccttgaactgcagagcctttttttttttccatggtgttctattcctccttctacacattagatattaaggtaatttcaaatgttttgttcatattatgcttaaaataattaggcttatatatttatataattggtttacatattatataaatctatatttaaaatgttaaaatatttaagtggtttcatgtgggtcaacctaattacttcctatacaaccaagtataagtttaatacgtttatgtttattttttctaatttacatctgtctactttatggttgcatttttgtatcttctgtatactaattatacagtttaatttaaaaacagtttctgagggttaattactttgagagtataactaaaggaatttaatgagtgtaattttttcaggatgatgtaccagagctagaagaatatttcctggtgaatttaacttacgttggacttaccatggctgcttcaacttcatttcctcccagactaggtatgaggggtttcttgtttgtttctttttgctcacttcaaatgaaatgaagaaacttcatttttgaatcagaagtgatcattgtgctgttttgttaatcttagctatgtgttaaaatatgatgggcttttatatttatttttgatactctcatatattgcaatttttacaatgaacaatgtaaagacattaaaaattattgtgtgatgctctttaaattttacaactattttataaacaaatttgtaatcctcaaaatagctctttggaaggtattttcctttcattttcttttaaaattagctgttttcagtagatctccaaactctcagatgtttttattttcttttaggttaagcagtgctgatatttgcttctttgttgctttattgtgttctctgcttctttcatgaccttttatctttttcttttcatgcttttagaaaagactcagttaattcattacagactgaaaggtaaaacctgagccttggtacaaacttatctagattcctttgaaaagatgtattcctatgtttaaacacaaactcctctttcagtgtggacatttactactgggaaattttgtctgaagcctgtaggtgtgatggcccactagagggtggtgctgagttggttagaaggagtgctggacaggggaaagttaatttggattaaaggaagagaagcatggccaggagcagtggcctgggaaacaggcattcctcattcatttctgaagctcactgtgataactttgaaaatattgaaaggaaataatcagtttctaacctattgtttgaataaattcagttcttttgctaaagaaatagatgattccaatgagtaggctgtttacatcaagtattattacaagataattattattcacactaagacaactaacaaaacaattcatatttctttcatcctcttactgagataatttgaatagttaacttctgttgagtggtttctaatgctcctatttcaagtgctttgtagattagtaatatcattacttacattcttctcattttacagatgaggtagcttaggctaagagaagctgcgtaatatgccccaaatcacacagctggagactggtagagctgacttcaatggtgtggtctgattttagaatctctgctttttagcctcttgtctgatggatgcaaaccctgattttatatgctttcctggacagtgttgttcttttcactctacagagaattacactctccctaccctttccccatccaggcagctaccataagtgtcctagactaaggtagcacctctgaaatttaaaaggtaaagaacaaagtattaaaaacaaaaatcaaaaccaaaccaaaacactaatcaggagcaggattagttaatattttaagactagcccaggagcagggttagtaatattttaagactgaaaccaaaaagccaaccaggagcagagttagttaatattttaaggtattggtaacatactaagtttggtggatagaataaaaataaaaagggaagataagtttactttgatattaatctctcttgacttcaccaaactttttccccatctttcccatgtgtctctacttctgtttgtgtccatgtctctctgtgtctcttttgcacacctctgttttctctgtacctttccttgcacttctttcatttatttttcatttttttttgctctttctactccttccaactgtccccattttcctttcctcctgaaatagtgatattatagaatagagatgccaaatatgttttaactaattaaaataatagaaacaaaatagtaatctcagttgtttattattttatactgttctcagttgattaaatttctataaatcagtggctcttgttagccaaaagtgtccttattcagacgtgataagcattgtctctttattttcttaaacatcttttgagtaatgttgataatacctgtacattatgaattatataatttcaaagggactgtctttaaatcctatatcaaaaatatttttaatcatttatatgtattttaagatatgcttctatgttttttaagattcagaaggtttgactgcacaagttattattgatgccaatgatggggcccgaggtgtaattgaatggcaacaaagcaggtaaggccaaggctgcatgagagccctcttctgggtttcatattatttactatctaccaaataaaagtttctaagggaaaaattaattttttttgtttgtttttgtttttttgctatattataggtttgaagtaaatgaaacccatggaagtttaacattggtagcccagaggagcagagaacctcttggccatgtttccttatttgtgtatgctcagaatttggaagcacaagtggggctggattatatcttcaccccaatggtgggtctcaaaatctatcacagatgacttttacaaattattttataatcattattccttgagaattacagtgatttaggtcccatataaataaattattcttaaaaaccattgtatttttcacagtaaattaggacagaagatttcctcatggtaaaatagttcccttaactattttagtaaatataaattgaattttcattactattctaaatgttattctgtatgcattaactatttcattacagtatttgatactagagaatacaagctgtaatattaaagaatttatatcattagataatcttcccagaatgtttcttacacttcacgaaaattttaactctttcatttctttgtttttgctcactgaaacacgtttagtgttttaaaatacttttacttggtctcttcatgccttttatttcttagccaaatgtttactttcttctcttcccctataatttttttggagacaaagtctcgctctctcactcaggttggagtgcagtggtgcgatctcggctcactgcaacctccacctcccaggttcaagcaattctcctgcctcagcctcctgagtagctgggattacaggtggccaccaccatgctaattttttttgtatttttactgtattttatatttttagtgtattttaccatgttggccaggctggtctctcaatctcctggcctcaagtgatcagcccgcctcggcctcacatagtgctgggattacaggcgtgagccaatgcacccagccccctcttaatttttactttttaaacttaatgttgccaatttaaataaaaagatataaaccaaaatataaggagacaaaattcaatgtaaaatagcttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggttggaacagtttgatattgttgctaagagtcatcctactccattgcttgataggtattgtgctgactgtttagagaaggtaagaaagagacaaaggagaaaactcgggaacatacagaacttgagggttggaagggctcttaaaaagtcacttccgttcattctgatgatagacaagccaaatgaatttcaaggattgaatgctgactgacccttcaaactcctgttttagtcagtggctgagctggttttttttaaaaaaaattttagtttgatgaatatttgcattcctgaattattggcctttatggagaaatttgatttgtagtagaaaatataaaagaattctgagtaacccaaggattggtttttacttttcttgctattttgataaaatacattgatatttctaagtccccagaagcctttttttttttttttgaggctgtggctgttgtttcaagttcaaagagtatatgtttgagatcaaatcattttcttgtagaacatagtggggtggtaaagcgttgtatgaatgaataccatgtgttggttgagaatagtctatgtacaaataacagaaaacccaatgcaaatggatttaaacacatataatttattggtttatttaacctgaggatacagcgacatacacctttagatgaggcaggagcaggacttaatgctgccagagatcctgaggttttctgtctcttttctttgccttttggaatattggcttcattgcaaggctaatgttattcattgtcataagatggtgatcaggaccattcttctgcatttcatataacaggaaagagagagtattcaaattcatgcattcctataaggtccttataaaaatctgattgaaattacataggtgacatgcccacctccatgagtaggagaaaggaatatagtattgggctctctcaagcttactttatatttgtaattttctatttttaaagattaagaaattcctcagagcaaaaagtgctttgacagtgagtcgtttcttaaaccatgccccattgattgaccttgagactatttccaaacccttataaagtttcaataaatatccttttacataaatctctatatatgtggataattaagattatctgttgagtacagtgcatgttgagtgaaaggactcatccgttgccttctttgttagttacatttcaatgtgtacatatacgatagtttctccatatccttaccagcaatttctttagtctttaaatttttatatgccatttctaatgactgaaaaatgtgtggttgtattatacattattgtgcattttttctttcattttcctgattgttagtgagcttgacactggtttgttttttttttactttgtgatcctgtttttcgtatcccttatgtactttcctgtggtttttgctttactggtttgtaggaatagttatatattttgaattcaacactttgcctcttaaatatattgcagatatttctcccagactgtcatttatcttttattataatgtctcttattataaaaatttttttaaatttaaaatatcaaatattttctggtatgcttttaaatcctactttcttaggtcttttcacccaaatgctataaaatattttactatattttctactattttcattgttttgatttatatttacattattgcacatatcaggaatttattcattggtagtgtgtgaggcaaggatacaacttcatttttcttctaaaatgcagaaaataataccctcatatcgtacagagaatgaaacatccattagccattaattttcaacatgaaatatctacccttctttttttccttttttctatccatctacctatcattttcctggactctgttttgttctatttgcctatttatgtgctaatagcatactgctttatttatcatagccttgaagtacattttgctagtttttcaggccaaatatttttctttttctttctctaaattatctcacctattccttaaaaaagtctctttcatatgaacattagattcaaactgagatctataaaacaaacaaactattttgattggggttgaattaaaattatggattaatttggatggatttgacatcactgtaatattgagttttccaatttagaaatataaaatgcctctccagtaatttagatcttttataccattgccttcccttgtgttctctcaaaaccaaactgtaagacaaggatttggacaaggatttagtttatttgagaggtgatctctggaggcctgatgagaaatgaggaggtgagagagaggaaagctgatagatgatgtcctaatgagcagtactgctgtgggcaactgacactcagtcctgctggtgttcctcttagacactgggttgaatgaagcttaggactgtcccatgacaaggaaagaaatctgggctgttcatttaccagctcctatttctgatcatttgagagttgctcttgggtgttaaatttgcaacagttctgtccttactcctgcatgggctgatgctgtcttcaggtagagagagaccactaggcaaataggaactgctgcaggtgactttagagtgggtgaaagggaggtgctgacagtgtctgccacagttatacattaaaattttgtgattttcttcatataggttttatagtttttacattaggctaatttctaagtattgttgctattgtgaataaggtctacttttcttttttttttttaaatagctgatctttagagatattataatagtctttaagaatgtatgatctgaagcagactttctgactttgtgcaccaggtctgccacttcccagcttgtaaacttcttcaaattacctgaatgtccttcaatcataggttctgtaaaatgagaataataatataatcaatatcatagggttattgtgagaattaaaagagttaatataggttaagcaattagtaagttcttaatagtattagttgtaattattattaatataagtgacagtaaaaaatagaacactcttgatttgtgaaggttactcagcttgctttgtgttcttactgtagttctaatattttctcttacattttcttagtagacaatcatgtcatctagaaaatagtgacagttctgactctttccactacttttacaggtgttatctggctgatagccctgggacactgttaaatagtaacaattatgacagacattattattttgtttctgtttttagtgggaatgctgctaatgtttcaatatttgatatttgttgttgacttctgagagatactgcttcatcaggttaaggaagctgccttttatcccaagattactgagtatttttctatcatgattgaatatgttattttattaaatgctttaaaaaattctgtcatttttaagatcatcttaagacaatcaccttaggtaaagagttggcctagttttcaattagacatccacacttttttcagcatttataacctcttctattttcatttgttgctttaatatttttattttggcagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggtacagtaagaagctttaatgagaatggaagtttatctttaatatttacaaaataaatttctcttagatgagcactcaagtcctagaatgaaaaaacaatacttccagcttaggtgttagacaaagacatgattcatttactatgtgacaagtgctgtagttctatttactctgtataaagcgcaactggaaaaatttactattaatagggtaaaagaatatgcaaataataaagaaaatatatgtatggctattttaaattttcagcacatttaaattgcatatgtcactttatattgtgtataaaccatataaaagaaaacccaagccaacttttgtaaacattaagtcccagccaatcatttccctttcaccacatttttgttgaacaaaatgtaactgcttacttcagactgcttgtttgacaacaagaatagtttattggagaaaaaaatgctggatttgggataaatatgatctatactcacagtttaccttcccaaacctctttttctatatattaacaattttctgttcctgctactaaactttattttttaaaacagtttaagtttaaaatgcagcacaccaacatggcacatgtacacatatgtaacaaacctgcatgttgtgcacatgtaccctagaacttaaagtataataaaaaaaaaagcaatttgcaagattatgttgcaaatgtgatttttttttttttttttttttgaggcagagtctcactctgtcatccaggctggagttcagtggcgcaatctaggtttactgcaaactccacctcccaggttcaagtgattctggagtgcagtgacgcgatctcagctcactgcaagctctgccttccgggttcatgccattctcctgcctcggcctcctgagtggctacaggcgcccaccactacaggcgcccaccatcatgtctggctaattttttgtatttttagtagagacggggtttcaccgtgttagccaggatggtctcgatctcctgacctcgtgatccgcccgcctcagcctcccaaagtgctgggattacaggcatgagccaccacgcccagctattcccagctaattttttgtatttttagtaaaaatggggtttcaccatattggccagtctggtcccaaactcctggtgccaagtgatctgcccgcctcaacctcccaaagtgttgggattaaaggcatgaaccactgtgccgggcctgtgattattttgactcattttttattgtggaaaaatacgtgtaatataagatttaccattttcaccatttttagtgaacgtttcagtggcattaattatattcacagcaatgtacaaccatcaccaccatctatttccaaaatttttcatcattccaaggacaaactctgtgcccattaagtagtaactccctattactcctctccctagtaatctccagtctactttctgtctctatgaatttgcctattctagatatttcgcatatgtgaaattatacagtatttacccttttgtgtctgacttccttcgcttagcaaaatgttttcaaggtgcatctgtgttgttacaggtatcagaacttcattcccttttcacagctagattatattttattgtatgtatataccgtaatttttaaatccagctatctgttgtttccaccttttgactcttgtcaataaagctcctattattgtgaaaataaaataaaataaaatagctgattatgttagctttaggcatttttcaagcctgctgtagaaaatataataaatctaaaataatagatttaaagctattttgtctaaaacagtccatctaataattatttttttaaatgatcattttatgtaacttcagcacatttgcaaatgcatattcattgtcatggttttttttcacattttggaaatttaaaaccttaattggtttgtgcaagatcacttacatttaaatcttgaaatatatatataaaaattcaaatttgaaatattttattaattttctattgctttattcatgttttttcatctttaaaatttttctcaaatttgttgtttttttttactgtgacttttttcataaaagactcctttttcacagtatagctatatacttttctttttattaggcaaattaaatgttagagcaaattggattaaataaattttttaaccgacataactgtttttattccaaaaagtttttattttgaggtataagtagtaaaatacacaaatcttaagtatatggcttagtgactgtaaagatatatatatacatacatgtaactaccactcagattaaaatatttaacattaaagctgggcgtagtggcacacgcctgtaatcttccgggggctaggcgggcggatcacttgaggtcaggagttcgagaccagcctggccaacatagtgaaaccctatctctaccaaaaatacaaaaactagctgggtgtagtggtgtgtacctgaatggtactcaggaggctgaggcaggagaataacttgaacttgggaggtggaggttgcagtgaacagagtgccactgcatttcagcctgggtgacagcacaagactctgtctcataaataaataaataaataaataaataaataaataaataaataaatgtatttaacattatcatcacccggaagattccccctgtctcttcccctttccagaggaaactactttctgatttctatcattgaagactcattttgctggttcttgagcttcatataaatagaatcatacagtgtgtactcttttgtgtctggcttctttcactcaatataatgtttaggtctgtatggttgcatgcatcagtagttggacattttttttaatcactgagtagcattttataaaatagaccactattggtttgtctgttctcccactgatgaacgttcggatgtttctaatttgtgcctgctatgactacaaatgtttttttaacagtgaaccctagattagaatgagattaatcaagttatgtagccagagcaggacaaaaagttcacaaaaatgaagacatagatgtaatttttaatcaatgttattttaaaatgcactaaatattttttggacactttagtgcagtatatcacaaagttgaaaatcctaaaagtagtaacctgaaacagatgtaaccatcacattataggaatcagtattaaatcaaagtgagatgatatttttcaaaacatgctattttgttgtcagaaatgttcagtagatttcgctatatatgtgttacaaaaatactgtattctagtaaccttatcttttgattttgttttcaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaataggtatagtttattcataaggaaattatcacttctgaagctataagtagggaatattttttgacataagaaaatgcagaaggaaattgatatctgattattttaaaagggatttttaaaatgaactctagaaaagataggtctagagagaccagttactctcctaactgggagtatcaaaaacctaaactcaccctgttattagaatggtgttattagaattcttattttctcagagttcacactttcaggtaaaggtctgtactattttgtgttttaaaaataataaaaagcaagaaataatagaaagcagacttaactgctcaaaccaagtgaatgactcttcaaatatatattaacatgattgtggttttaaaatttcttctagaggctgacaaatatttattttttatatcataaaaatattttaatagatctagtttcattaatatgttaatttcctgactcatttttttcctataaagtgtttttgatacatgtgtgaagaaacataagaatgacaattttatttctttttcagaatatagagtgcaaagttactgaagtaactgatttttagtattttcttatcatctcatcttggattgtgtaaatttaaaaatgtattaagtatatgctagcaatatgatatatatttcaaatatgtagaatgtatactttttctgcttccctcaatccatgtatttctttcagagccacctccatagacatcgaagaagccaataggaccgtgtatttaaatgtatctcgaactaatggcattgatttggctgtgagtgtgcagtgggagacagtatctgaaacagcctttggcatgagtatgtttcatttcttatgagaacaaaattctgtaacgaaaaaatattgcatgtataagatttatattttttcctttgaattgtatgttattgatcatttgaaaatggaaaacagataatctaattcttttattgcatctataaatatgtgttgaggctgggcgctcatgtgttgaggctcatgcctgtaatcccagcactttggaaggccgaggcgggtggatcacaaggtcaggagatcgagaccatcctggctaacatggtgaaaccccatctttactaaaaatacaaaaaattagccgggcgtagtggcaggcgcctgtggtcccagctactcgggaggctaagacaggagaatggcgtgaacctgggaggcggagcttgcagtgagccgagatcgtgccactgcactccagcctggtcaacagagcaagacttggtctaaaaaataaaataaaataaaataaaaataaaaataaaataaaataaaataaaataaaataaaataaaataaaataaaataaaataaaatatgtatttagtgcctatgccaggcatggcactgaactcgtggatcttagaatttaggggatgggggtgacagaaatgaatcaagtaagtaaaaatcaatgtatactttaaactttagtaagtgcttttgtcaaaggagaagttctaagtgttgaaagaatataggggaatgctttcaaggggtattgatctttgagctaagactgaatgatgagtagagattgattatgcaaaggactgggttggaagaacatggaggtgagagtgagaagctgtgaaggcagaaaactgaggcataaaaagcacacataagtgaagaacttgagtggatagtaggtacagaaataaggaggaatgttgagcttggatagctggacaagaccatatcattcaagaacttaaggaatattttatagttgccagtctttataatagtgttaatggaaagccttcgagtggtttaggaatggaggagagttaccatatgtaatgtggtatggtataatcatatatggattttgaagatattattcacagtgccatgtaaataatgggttgatacagaagagaagtgaagatacagggaggcaagatggtggtagcttagactaggtgttgagtatgaaggtgagggacagggaagtaccaaagatgactcaggcttctagcttgtgcagttggatgggagaaggggttcatgctattcattaagatggaattccaaaaaagaatagatgtattttagtaaggggagtaaaataaatgtggtttaacacattttgaatttgagttacttttgagaataaatttctctagactcaaaagaaggtctctgctgggccgggcgcggtggttcatgcctgtaatcccagcagtttgggaggccgaggtgggcggatcacctggggtcgggagtttcagaccagcctgacccacacggagaaaccccatctctactaaaaatacaaaaaaaattagccgggcttggtggcgcacgcctataatcccagctacttgggaaggctgaggcaggagaatcgcttgaacctgggaggtggaggatgccgtgagccgagatcgcaccattgcactccagcctgggcaacaagagcaaaaactccgtctcaaaaaaaaaaaaaaaaaaaaaaaaaaaaaaaaaaaaaaaaggtctctgctggagagataaaccttggaactttagctatatatattgtatttgaagtcatggaaattgatgtaataatctgaaaagaaaggctgaagatggagaagggaagaggacactatagactgaactataagaaggttcaacttgaatggctgaggatatgggatgatggcctagcaaaggagacttaggggacctggtaggaaactcaggagaaaacaggatggcagataccagcagaagagtgctttaaaatggaggaaaaagtaaacggtgtcaacccctggtgagaagtccagtaaaatgagaacctggaaaataattattataattagcaacatagaaggcattaatgaccatagaaagggctatttgtatagaaagatggggaattaataccattttgaatagaggtgaaagaagagagacctcaaatatatgcaaccatttcaagaagtttggcagggaagataggacctggagaaggtagtagtggtgtggtgtcggaggttttttgcatgtttagtttggagagacccaagcatgtgtaggttggatggaaaaggtagagaaatgttaaatatttagaagaaaaaggagataattaatagtggtatggttgtctagaagacaagctgagatgggatccaaaaaagaaagtctggtttctaatttagatttctgcattacgcttggactttgcatgtgttttttggaagtactcatgagagcacatgtcggagattcttaattgttagcagtcattgcttattcttcatttgtggtcgtcttgaattattgtagagaaggatttgtccatatgtcaggaccatttgggactctaaatgaaaaatctgcagtatacctttaaaagggagcaacataaaaatttaaaatgctggatttttaggaaaggaaattgctattggatattacatgtaaggcattgacaaattctcttgaattagtaatctaaaaatgatcaatcatttatagggagcccaggtttcaaccttgatagttgttcttactgcatcatgttcacaccattaaccaaaatttaaaaagaacttaatgttttggagggaagcagccatgttaagagactatacattttttaaaaaatgtttactcctcattagttaggggatttttatttttgccctttttttttctttttttttgtagtacagaattttaaaacatgtaccagttgtagcagtttgataaaaccttgacagccatttgaaatatgtgagtctgcttggcattcttaaaatgtataaaatgtaagtgaaaaattagataggcataatttcaaatttaatagcgtaaattttttaaaccaaatatcatatttctataaaaagtatttattattataaaatttctcagttatattttcatcagctttacagaagttgataaaaatcatgttctgcatatttccctttaaaatatacatttagtatttatttagttagtttttgagccagggtctggccatgtcacccaagctggagtgcagtggcactatctcggctcactacaacctccgcctcccgggttcaagcaattctcgtgcctcagccatccgagtagctggtattacaggcgcacaccatcatgcccagctgatttttgtatttttagtagagaacggtttcaccatgttggccaggctggtctcaaactcttgacctcaagtgatccacctacctcggcctcccaaaattctgggattacaggcgtgagccaccatgcccagccacatttagtatttatttctaaatacaccttggaaaagtatgtgtaggtataaagcagagctttaacaaattttcttggtttttaaataataatttaaaaatattcttatttgtagtacaaattcattatttgtagttattttaaagttttcccacttgtgtcttttcacactcatacacacgtcatgaaagaattttcatttgtagtcacaaatgcacttgtctcattgtttaaacaataaattagaatagataagtttttgaaggagtaataaactagtaaaccatgatttgtgtttttcagggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggtaaacatcagtatttttttatagtacaaaaataaaatgtgcagataaattttagatgtataatgaataactgtattcttattcctcattttctaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtaaaaacattttcatttttaaatagattactttctttaaaagaaattaagatttgtaagattgttcaaattggaagataatgtatgttttatgttaatgtgaaaaaggactttttgtgagttgatatacattttagcaaagtatcttaatccggggatatttttgtctttttaaaatgacacttagttatgtgtagcttggtattaaaattttttaagtcttgcacttcagattttaactcatgctattagtgtgttcagtggctttcttagttcaactctcctttaagttttcattcccactctgtccttgcaggtacaaacaatcattattctggaaagttctcaagtaagatattttacttcagacagccaagattatttaatcattgcaagtcaaagagatgattccgaattaactcaggtttgattcttttaaaatgaagtgggtttttttttgcttttctttttaacattataattgaaatttaccaaaggtatggtctgctggtttagtataaaagaaaaccaaaatttgattgtggtaaagtagaatgtaaagactggttagttaaaagttaatttttaaataccagagtcataaaatgttatattatcttcaagagccaaggataatgtaacaataaaaatgaacatttaattagaatttaactgaattgcaaaacattgtggagaaacatcacacagccagacagagtatcactaaaaattcatgattagcattgccacacaggcattcagtatcacctcagaaatcccacatttctttagtaaactagatcttgtaattctagtaatgcttatttgataacttttgtcactccttaaacttccatacatgcttcacaattccattttcagctaattcccttgttgaagtgaaagctaccaaaaggggtattattcattttcccaacaccaaattcaaaaacccacttgaaacccaatcttagtcctcattcctgctacgacagagaaagtgtcccttctaaaaagccaggcctctcacataagtgcccaccttgtccttataaggtttagctattccctccatctctgacatctctctctctatttggttactacaatcagcctaaatgttctagcttcacccagcttaaaaagaaattcctcccttgatctcattcccttctagttttcatttcatttcctttctcccttctatagtaagacatcctgaaagaattttctacttgttttgtctttacttccccgtgctcaccaatgacaactgcattaccagatccagtgggtgtttttctgtgtaatcattatacattccaccagcatgtgacagtcacctcatcctcaaatataaatcttaccttgctttctaacacactacacaaattttccttttccctttctctctctgggtatgtgtgtgtgtgtgtgtgtgtgtgtgtgtgatccttctcagtccccattgccagttcctcttccctttcgtaaacttagatgtcttggagttttccagaaagattcacttatagttcaaatttcttttttctttctcttcactcacttggatacttttatcaatcctgtggttttaaatatcagcaataggctagcgtattttaaattatatctgtagcctttcctctgtattccaggcctacatacctaactgcctattgacatgttcacttaaatatatttttggtacataatatttaacatatcccaaactgaacctttgatttccactatgaaacttgttacttcagtgctagctttcatctcaggaaatagcaaccccacgaactcagttgcttaggacagaatcctgggatatttcttccttgattactcctttttattagtgggggggatggggtctggctctgtggcccaggcttgagtgcagtgccatgatcacaggtcactatagccttgacctcctgggctctggtgatcctcctaccttagcctcccgggtggctgggtcaacaggcgtgtgtcaccacacctggctgattttttgtattttgtagagatgggatttcaccatgtttctcaggctggtcttgaacttactcctttttattctttcacatcgagtttatcattaagtatttttgattatatgtgtcaataagtgaagacattttgtctctactcctccctactccaggtccccattatttctcttccacaccattatagtgtcctcctagctgttctctgaatttccttgacctcctcagatccattctccattgagtaactggaggcattttttaaaaatattaattgactaatgttatttctgattttaaaaccactcaatgatttgcaattatacttagaataaatttgaaattatttaatatgggcttaacataggatagctatatttcctgatttgccttggaaagtactggattatgcctgttctggtattgttattaatattgcccctttcactctttaaaggatccctgtttaggtgattaattatatggtcatcctaatggaaggtactccatgatgatcttacctctccagccttaactctcatcattctcccagcactatcagattccttccagtctttattcagataatgacaaattttttctgtcttaagaactttgtcatgttgttccttctaacttgatttcccaaataccttcataattctctatcagaccatcctaattgtcatcttcagtacttgactcattttatacttatacattgacttaattattgatatgtttcttgtttaccttttcctaatagttaataagatccataaagggaaaggtcgctgtatccatagttcttagcataatgtctgtggctcaaaagttcctaattgttgactgaataagtataattttctgtgacattgaccagcttgccttcaggtagggtctgaattttaattttgcatttatgaacacttaccctgaaaacttgcatacgttgactgccaccatggggacagaaaggatttaggtgtttctctgtattctattgctcgagcaattgataataatattgcagcattagaatgtttcttattccgttctaaatttttcatatgtagtgtatttcctggttttagctttccctttccctgctgtcaacaacccttacccagatgtacatttgatactgatttcttttcaaatatcttctctttcattcactctgtgtgtgtgtatgtgtacttatgtgcatagacatatatgtgcacactcacacagattagataagggagagagcagcaagggagcatcagttttagtattttcttatttatgaaagtatctttttaactaaataaaaggatccaagagagtaaacatatggtattgattacattcttgcaagtgctaaattcctagtcataaagggttttgtatttcaacatttccttcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggtgagaagataaagtatttgtagtgtatatataattattgaaatcatctagcattcatatggtatattttatatgaaaatgctcttgcaataattttttactaatccatagaatatttcttgatagataagtattaattgtcagctgtaaatggatttttgagaaatatttaagcattatacccctaatcttgtgttctgactactacctgaaagttatatgaaaacaaaattggaagtaggtaggtaaagttgaaagatacatgaatattttatacgcaggatgcaaacaagtaactttttatatgtatttacttgatgtgccatgaataatttatagtattagtaaataatgttcagaactttttataagactctttcagaatattcttggaaggaaaatttgctttctgctgctgagtagaactttcatgggtaaaattgcaacattcctaaaaaaattaaaaaaaattgtccttgttctttctttaacattatatcatggttaatgactaataatgtattcccgtcatgcagtaaatgcaaaaagacttttgaagtacttcctattaacttgtatttttattggactaaatggattctgaggaaatttgtttcttgatatttttattatagttttattatgtaattttgtcatttttttctgtaacttttgcattaagatttgacttctatttcattattgcaggagatcagaattcaattgatattttcatctgggagatgggacagtcttccttcaggtattttcagtctgtagattttgctgctgttaacagaatccactccttcacaccagcctcaggaataggtaaggacttttcaactgctcaccaattctaaaggtagtatggaaagccagaatgattttaatctcattgatttagatttagtatcacattgccagacactgggtatttttttttttttggagatggggtctagctgtgttgcccaggctggagtgcagtggggcaatctctgctcactgcaagctccgcctcccaggttccgctattctcctgcctcagtctccccagtagctgggactacaggcgtccgccaccatgtctggctaatttttttgtatttttagtagagacggggtttcaccgtgttagccaggatggtcttgatctcctgaccttgtgatccgcccacccaaagtgctgggattataggcgtgagccaccacgcccagccgactctgggtattttaataggaatgtaacatcaagagctttacaatactccttccagaaatcctataattttttgaaattcttttgaatttcaattttccttttgcagattaatactttcagaatggacattggcttgagaataatcagaataactaaaatatggaggaaaatattagtgaagaatgaaaataatatatttcttttgtctagagaaacatgaagagtgacattaaatatatatttttaaaatatgaaagtatgtatatggcaatagcaagtatttgcatttatgaattttttttaagttggagaatgactatgagaattcttccatcttcatgaactctcccaacctcctccacagtctgaaatcctttcttggtcttctgtactttaatccacacatcagaaacataagcaatatttttaatcactgtggtttcagaaacaaagtcgattggagagaacccaaggtattattgctgtctgcaggttgtaggattattttagggttggcaaggaatcccttgggtgggccagtgatgataaggagatgaagctgaggccagtggcatggtgagcttatcaagctggctcatggggtgggtgttcatagcacagggaggagacacagacagtgggtcatcatgtctcctgttgaggtgtctagagaatttgtgagccaagcctgagtggctccacaggtgactctggatgaatcatagtcctgcttttaaattgagatatggcaattctgtatgaattaaatggcacacagttattaatttgatattatatgtaagtcaatgttaccatgctatgaagaattcctctacttaaaagccttaatgtatggttggagaagcaagaaaaaatattaagatactaattcaaggtacaggactatattagtccattctcacactgctttagaaaactatctgaaactgggtattttatgaagaaaaaaggtttaattgactcacagttccacagactgtatagaaagcatgctttgggaggcctcaggaagcttacagtcatggcagaagggtgaaggggaagcaagcaccttctttacatggtggagggaaaaagagagcgcgaagggggaagtgctgcacacttttaaacaactggatcttgggagaactcctctactatcacaagagcagcaagcgggaaatccgcctctatgatccaatcacctcccaccaggtccctcccccaacactgaaaattataatttgacatgagatttgggttgggacacagagccaaaccatttcaatgaccaataccatttgctctgtgaggggtagaattggagtgattaagagagacaagagaaagcttgagctatgtctgcgtggattggcaggacacactttgggcagagggaaaggtatgagcaaaggagaaaggcagaagtgtttatagcattgaggccaccattggtagatgaaagtgccagcgacagaggatttgaccagaatgttgtggtgctgagattggagatacaacactggaatctagagaagatggcctggaatggcaggcacatggtgcgcctgtgcctcaaatcatccagcagttttcacacattttgctcttagaatctattcatatttattgtgtaagagattaaaactgagaaatgttaaagtcatctattttaaaatgacagcaatatactcattatgtgtaaatacaacgttatttttaaaaaacactttctaaaacgaacacttttatgagaagagtggcattggttttattttaatttttgaaaatctctttaatgtctggtttaatacatggtatatagattctactttatgtatttaattaatttttttaagggacagcattttgctcatttgtcaggctataatgtagtgatgcaatcatagcttactgcagccttgaacacatgagttcaagccgtactcccacctcagcctcctgaatagctaggactacaggcatgctccatcatgcccacataattaaaaaaaagttttttttaaaagtggagtttctttgtgttgcccagcctggtcttgagctccaggcttcaggagatcctcctgcctcaaagtgctgggattacagtcatgagacactgtgcccaactgattctcctaattaattaacttttttccatctttattaaggcttgattgacaaacattgtttatatttaagatatacaatgtgatattttgatatacatataatgatatgtatttcctcaattgagctaattaacccatccattacctcacatatttacctttttttgatgaaaacacttaaaatctagtctcttagcaatttcaagtatacagtacattattgttaactatagttattatgctgtagattaggtccacagaaattacccatcttataactgaaagttggtagtctttaatcaaaatcccccatttctctcacgccctggcccctggcaagcacagttctacaatttgcttttttgagtttgactttttcagattccacatataagtgagatcaggcagtacttgtctgagtctgggttctcatgtctgcatctgaattcagtctactccagtattatcagtcatttagcctctgctaagttctgtacactcatgaaagaatgagaatgaagtagaaaaacagcattattatgaaaacagcattattttcattttattatgcaaacagttttgacctctgaaatcctctaaaagggtttcagtgtctcttagatccctggatcacactcagcagtagtgagatagagaaatccttgaaggcttttcaatggcaaatgatgatcaaaggcatgttttacaactcctcatagctttggtgtatagaatatgctggatgaagtaacttgcaactgcctgggcaagagttgaagagggcctttagctggggtgagaaattaggaatgaagattcttgtgagaaagagaaattagaaatgaaaatccttgtgggaaagagaagttagaaatgaagattcaacagcacttgatgtctgttcaaatgtggggagcaaaagttattataccttggcaactgggaggagaatggttttaaattaggaaaagacacagaaaatgtctgtagtgggaaatgtgatgaacttgtttataggtgtctttagtttgagataatatagaagcatgtgtaggtggttagtagagatgtggaactagaatcagaaagaaattggagttaaaggtttggattttggagacatccatgcgtggggatagtcgaactcataaatgttaaagtgtacaaagtaaatgatattgattgcgaagactagaagatttagcacaaatacaggagtcagtatttggaatttttcccttaggtgcccaactactgctttctttatcaagcatttaacatttaggcagtgttaccttcagtcacctcaactactgaccaggaatcacggttatttatgtctaacttttaaattagtattatttttaatttacaagttataattatattacacatattgagtgtaatatgatgttttgataaatgtatacaacatggaatattaaatcaagctattaacatatccatcacttacttaacatttttgtgatgatacagttgaaatgtactcttagttattttgaaatatactatacattattattgattatagtcaccctggtgtgcagatctcaaaaattcctcctgtctagccaaaattttgtaccttttgaccaccaacttcccattctcttgctcttccccgccctggtgactattgttgtaccctttgctatgaattcaacttttaaaagattccgcaactagtgagatcatgcagtatttgtctttctgtgcctagcttatttacttggcataatgtcttccagatccatccatattgtcccaaatgacagaattttgttctttttttgaagcagaatagtattccatcgcgtatatataccacattttctttatccattcatctgttgatagatatatagtttgagttcacattttggctattgtgaatagtgctgtaatgaacatgggagtgcagatatccctttgacatactgatttcaatttcttttgacatattcttagacagaagtgggtattgctggatcattctgttcattgttgggggaacctccataccattttccacaacatcttactagtttacgtttctaccaacagtgcatctgcaagcatttccttttctcctcttcttcaacacttatttttgtgtaagatttattctaataggtgtgaggtgatagcttattttggttttaatttttattttcctaatgattagtgatcagcatttttttcatgaacctgttggccatatataaggcatcttttaagaagtgtcttttcaggtctttagcctattttttttttttttttttttttgagacagagtcttgctctgtcgcccaggctagagtgcagtggtgcaatctcagctcactgcaacctctgcctcccgggttcaagtgattcttctgcctcagcctcccgagtagctgggattacaggcacctgccaccatgcccagctaatttcaccatcttggccaggctggtctcaaactcctgacctcatgatccacctgcctcagcctcccaaagtgctgggattataggcgtgagcccctgggcccggcctagcctattttttaattgggttgtttccttgctattgagttatttgagtttcttatatagtttggatattaaccatttatcagatagctgtatgggtttaaaatgttttttcccattctttgggttgtcccttcattttgtgattgtttcctttgctgtgcagaaactttttaatttgatgcaatcccatttgtctatttttgcttttgtcgcctcaacttctggagtcaatcaaaaaatccttgcccagattaatgtcatggggatattccccgttttcactgagtagtttataacttaaggtctttaatttattttgagttgatttatgtatttggtatgaaataatggatctaatttcattcttccacatgtggatatccaattttctcaacaccatttattgaatagactctctttcttcattgtgtgttcttggcacctttgtcaaaaatcaattggttgtgaaagtgtgagttaatatctgggctttctatcctatcccatttgatcagtcagtctgtttttatgccagtaccaagatgttttgatcataattgctttatattttgaagtcaggtagtgtgatgcatccagccttgttctttttgcttgagatcgttttgtctattcagagtgttttgtggtttcatatgaatttaaattttttttatttctgtgaaaatagaaaaatgataccagaattttgataaggactgcattgaatctgtagatcactttgggtagcatggacattttaacaatattcattccttcaattcatgaatatgggatatctttttatttatttgtgtttttttctatttctttcatcagcgttgtacagttttcagtataccagtcgttcgtctttattgctgttgtaaataggcttgttttcttaacttttttggatagctagttattagtgtatagaaatgctacagatttttgtatgttgattttgtatcctacgactttactgacttcagttatcagttctaagagtttgttttaatgcaaactttagggttttcaatatataaaacatgttgtcagcaaacagagacaatttaatttcttccattcctatttaggtatgtcttatttctttctctcgcttaattgctttggctggaactttcagaacgatgttgaaaggaagtgacaatagtgggcatctttgtcttggccgggatcttggagaaaacctttttcaacttttcaccattgagtataatgttggttacttgtttgttatatgtgacttttattgtactgaagtacatttcctctatacctattattttgagagcttttatcatgaaaggatgttgatttttttcaaatactttgcatcaatttagatgattatttggtttttcttctttattttcttagtgtagtgaatcacatttcttgatctgcatatattgaaccatccataaattccaagaataaatcccacttgatcatggtgaatgattcctttattgcattgttgaattcaatttgctattgtcttactagggatttttgcatctttgttcatcagagatattggcctgtaatttctttttttcttatagggtctttggcctttatatcaggataatgctggccatgtaaaatgaatttggaattatcctctgttcttcaattttttggagtattttaagaaggattggtatttgctcttgaaatgtttggtagcattcagccataaaggcatcaggttctgggactttctttgatatgagtcgttttatgactgatttaatttccttactcattattgatctgcttaggttttctatctcttcatgattcagtcttagtaggtgctatgtgtctagacgtttattcattttttcaaggttatccaatttttggcacataactgtggtagtttctcttgatcctttgtatttctgtatttctgtggtatctgttgtaatgtctctacttttatttctgattttgtttgaatctgcactttttttcttagttgatgtagctaagggtttgtcaactttttcttttaaaaaaaaacaattcttagttttatttatttttttctattgtttttctagtcttttatttatttttgctctttgttatttgcttccttctgttaactttgggcttagtttgttctttttctatttcctttagttgtaatattagaccatttatttgagattttatttctttttcaatacaggcgtttattgctgtaaattttcctttttggactgtttttgctgcataccatacattttagtatattatttttatttttgtcataaggtatctttttatttcttctgcaagtcatttattgtttagagtatatttaatttctacatatttgtgaatttcccaagatttcttctgttattgatttctagcttaatgccattatgatcagaaaacatacttgctatgctttcagtgctcttaaatttgttaagacatgttttgtggcctaacatatagtctatcctgaagaatgttctgtttgcttgagaagaaagtgtattctattgcttttggatagaagattttgtatatgtctgttaggtctatttggtctacagtgtaattaagtccagtgttttcttattgatgtgctgtctagatagtcagtttattgttaaaagtgggatactggggtcccctactattattgtattgcagtctatatcacccttcagatcacttaataattgctttattatttaggtgctccaatgttgggtgtatgtatatttataattgctatgtcttcttgatgaatttaccctcttgttgttatagaatggtcttctttgtccctttttatagttttttacttaaagtctattttacctgatataagtatatctacccttctgttttgacttacatttgcaaggaatgcctttttccattccttcattttcactttatatgtgtcgttattggtaaatagtctcttgtaggcagcatatgattggatcttatttttttttaatacattaagccattctgtgtcttttgatgaatttaatcaatttcattcaggataattattaataggagcagacttgctactgccctttcattatttgttttctgtttgttttgtagatcttttgtttctttcttcttctgttgctgttttcctttgtggcttgatggtttcctatggtggtctgcttttaatcctttctttttatagtttttgcttccacagtagttttctgctttgtggttaccatgaggcttacataaaacatcttgtactcagaaacagctattttaaattgataaaaaattaacttcatagcaaacaaaaactatatttttatgttctctcccctaaaacttttatgattttgatctcagaattttttttgtaatttgtatttcctaacagtttattatagctacagttatttttaatagttttgtcttttaaacctgagagataaatttgctttatataatcaccttacattattagaatatcctgaacatgactatattacttataccattcagttttctttaaattttctcatgttttatgttattagttatcagactttcatttaagcttaagtaactccctttagcaattctatagagcaggccgagtggtaacaaactctcttagcttttgtctgggaaaaatttaattctctcttgtttctgaaggacagctttcctgagtaaagtattcttggtagaagtttttttccccttcttcattactttgagtttattattctactctctcatggtctgcagggtttctgctgagaaatctgctaattagccatattgagacgcctttgaatgcgactatattctctatctcttgctgctttcagtattctttctttgtgtttgatttttgtctgggtaaactcttcattgagttgaatttgactggagaactttgagcttccaatttctagatagtgttgtctttccccagatttaggcatttttcagccagtatttttaaaaataatgattcttggtattttttctttctcttctttgggaactcctgttatgtacagcttagttctcttgattgtgtcacataattcctatagaccttctctattctttttcattcttttttatttttgcttctttgactggataactttaagtatcctatcttttaattcactaattttctttcttctgcttgatcaagtctgctgttgaaattttctactgaatttttagaatagtcattgtattccttatttctagcgtttctgtttgtttttttgtttgtttttatttctttgtcaaatttcttattttgttaatgaattgttttccaaattgcatttactgtttcatctgtattttcttatagttccctgaacttcaagagaattattctgaatttttgtcattcattttatagatctccatttcttcaagatccattattggaactttattaatttcttttggtcatatttccctgatttaaaaaaaatccttatgttggcatctgcacatgtgaggaaacagccacccttttcaggcttttctagtgttctgtggtggtgatagaacttcactatttagtctagcttgggattctggttgggttagttggtagtgaccccagacaagtagactttgttatcatgttttgtatttgggctgggctgttacctgtgacctgggatcaaatggaagtgctggctgtgctctgagatccagtgacatctctggttggggtcttcagtaagtcagagctgttgcctgggcgtagtaattgcctctgatcagtgttgtagattgtcttctctggctggatagtgctgtggtttgggatctatatctgcacagggccacctacttggctgggaggctgggtgaggtgtctagattgctacttaactactcagggtaggcaggactgcaggctatgctgcatagatatgcatggacatgggcttgcctcccatactagggtaaccttaagcacagcactgaggtttggtttagtagctgtttagctgctgtagttgagcagagtcagatgctcccctcagaagacattcacacacatgcacatgactccttgcctggcaagggcttaaggagagccccaggatttggttggattgatgctcactagctgagtctgggcaggactagattcagataattgctgacctgcttttaacttctagcttggagcgaagttaaggaaagtactggggcttggctaagtcacagctctgcagctgggtctgagtagggtcagatgctctctttggataatccgtgggtctgggaagggtcagagggtccctttgtggataatgctgacctgcccttgcttcttggcctggaagtggctgtgaaggagatcaccagggcttggctagatcacagctctgtggctgcatctaggtggggtcagatgctccctctgtgaatgatgacaaatgtacccctgccttctggcctgagaaaggactaaagagtactctagagcttggttgggttgcagctcaatcactaagcttgggtggagctagatgtttactcagcagataattatcaacatgccgctatctcctggcctggggaagttttaaggagagcacgcaggctggctgtggaagctggccagggatttgggcctgggaggcctgtcaactgtgcctcattcagagcaatgctgttgggtattctttctggtggtgtgcctccactggccacaaggcagagccgccaccaagatctgcttgtctgtcactgtgagccctacccctgttcgttgtttctaagtgacctcaggtggtctagccctgttgatagctagtgtttccagtggggcaagacaagggagtgttacctgtgaatgggcccagaatgttggggaagctgaatgtctgcctccaactcaactctctcttccctctgtaaaaacccacagttcccggggaatctcttgtgtgccggactgtgctggcttgggggaggggcaacatagtcaaagagaaactgttcctcttacacttcaattgtagctgttctttgtctgtggtccaaggggttgtttcagcctcactcccatgttctgggatattcatcaaggtattcttgtctctgaatagttgcaaattggatttctgtagaaaacggtggagccagagagttcctattccaccatcttgctgatgtcattctatttacctctcactttttatagattgtttctcacattgtactttgtttccatgttttctactccttcctcctcatccctgtggaatgcccataccacattctcccagtccccagccaccttctacctggactattacatcacttcctggcctccacactatctttactttgccatcagagtcctctgcctgtctctgttctgctcattctttccttaaataacttctctttacattgtcaacactttgactcgtcataaatctgttattatcctaagatatacaacttgagtgacttatcattcaacaagtgatttgttgagtaaattatgtatctttcatcatatatttgtttagtttttgtctacctgtcctttaattttttgcctttattatatttgcttttcttattcctcaagtattcaagtggactaactatgtctccttgagtcacttattattattcaaaatagttgcctaatgaatgtttttaaagatgatgagtgctgcctgaagggccattaattaaagttatagaattctctttaaagatttaaaaaatatataataggcatactttctaaaagaatttgcaaaaaattctgccagagacttattaaaggacccattgtgaggtctctttatttcttttgtttctgtgacttgaggctgtagaagtatgaaaagattgtaggtaattatttagaatggcttattatagatctcctgaaagctgaaattatgcattaaataatgttcaagggctttcttattttgaatgtgtcaaatattttattaaaagtattagattggagctataaccatgaggatcacatatttattctggttaatgacttgacagagattattgggtggtgactgaattctttaaatggaagaagaagaatgaatatgacaaagactacaaggacatacaaacttatcttcgctttcacccttttctcctttagtagttaatagatatttttaagtgcaattatgtgccaagcacattgatagaccctggggaaacaagggtaagcaaaactacatataaaccctgcgctgaagaagttttacaagtagcagggaagagagatattatgtataatcatacatataagtttctagttataaatggataactgctatgaaaggatagaatactttcatactacaaaatgagaggacttgccctggtctaagagatgcccagaaaacttacttaaggaagaatcatttaattgagaattatatgttgagtaggagttgaagaggcagagttgatgatggatcagctctaggcaaagagaggtcaggtggtggtggtgagcatgtgcttttagggaactagaaagggaccaatgtggcccaaatacagacagtaagggaacagtgatactgggtttaactgaagatgtaatcagatagggacttaaaggattatggtctttatcctaaaagtattgagatgcctttcttgaggaggtgatggggaggtggagatagagagatgggcagagagaaagagagagcatgtgtgtgtgtgcgcacgggtgtgcatgcatgtgtggctgccatggaggaaaaacttaaatgttagaagagaagatgtctgagaaagagctggaggcgcattctttagagatgttgaaagatgaagcttggaaagtggtaggtgatgctggttagagaagtagattgattcagatgatgtctcacaagtaaaaccacgggggttggtgatagattagatacggagggagacaagaaagaggatgtcaaagatgagccctaatttctgcaactggtgggtgaatggtagtactgtaacttttgtggtggtgattgcttgggagaggaccaggcttttaggggcagagaaaatgagtttggttggaatatgttaagtttgccattcacatgcagagtaagcactactgattatagagtttagaggagggtcttggtttgctgatatacattggaagtccgtgagtacagaaggtcattttactacaggcagaggttatcttggttgagactattgaatcagctcattttaaacttcagagatgttgagatgcccctgaattaatttttttactcagtgtctccagttttataaaacttgatgaaaaatatatggccatttaaaatgcaaatttattgatagcctttttattgactgccttaactttttatgcaacgtttgctgaagtgtgatagtatttaagtccattactataaataagcacgaacagtggttcttgatatgtaagagtaaggatatggggctttccgttgtaacctatgggctaaaattgtagaagaggctcatatgttcttattcttggtgctattttaatatctaaccaatctcatttgatatcttttttttttttttttttgagatggagtcttaatgtgtcgcccaggctagagagcagtggcacgatctcggctcactgcaagcttcgccccctgggttcacgccattctcctgtctcagcctcccaagtagctgggactacaggtgcccaccaccatgcccggctaattttttgtatttttagtagaaacagggtttcaccatgttagccaggatggtctcgatctcccgacctcgtgatcttcctgcctctgcctcccaaagtgctgggattacaggcatgagccaccgtgcccggcctcatttgatatatttatgttccaatgtgtttatctaggtactggaatttgtacatgtttttctatgatttctcattttttctcccagttttatttaagtctggaaattatttagtattgtatataatatagtaagcccccttccttcttaacttgtgtagatataaatatgtcctttggctattttttacttcttttttagaagcaaccctattaactgatatatatatatacatatggacaagatctaactctgttgcctagggtagagtgcagtagcatgatcatggttcattgcaaccttgacctcctgggttcaaacgatcctgccacctcagcttcccaggcagctgggaccgcaggtgcttgccaccatgcctggctaatttttgttttttgtaaagacaggctcccactatgttgccgggtctcgaacccctgggctcaagcaatcttcctgctttggcctcccaaagtgctaggattacagatgtgagccactgcacccagccttgctttgaactatcaaaagtatggtttcctgataacatttcaaaaacattggaagaatatactttaggagtcataaatttgttcatatcctttggcctaattaattaacttgaagaatttatcaagtgaagataattaacatgaataattctgtctctacttaatatttaataattaaatatacaataacaaatatcaaatgtagggaaattattaaatatattttgatcaaccatatatattatctatgcactgaaatcatagacttgaaaactgtgtagaaacagaaaactgtaatagtatggacatggtgtaatattgttaattaagagttttttgtatttatactgtttataactgtgtcaattatgaattcatatgaatgataactagaaaggaaaatgaagcatttcatgatgggattatgagtatgtttcactttttaaaatatcctaatatgctatctaataaatattaagatgaatataaaagagtttaaaattagtttcggttttagcagccagtaatttcttttttattaaatgggtatggaaacctcatcaagctggcttgatcattctaaagcacttaaaaaattattatttacgtccagttatttcagaaattgaagtatatttagttacctcagaaatcacaatggaactttgagattttggaagattttgctttggaaccgatgcagggagtgtgggaggtgacagtttatatctcactcaagttgttttttctttccttcctgcagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctaggtaggttcaacattttttgctaagtatctttatgttcactgtaattttgtatgacagctcatttccaagtcattatttggtgactgaaaaatatacaaaatataagagctatttatcagcctgaaatttggttattatccatgtttctaatatctattctatcaagtttatcagtattacatgaatattttggattaaaattttcgttatgaaatgttgtgattcttccaaacctttaatatcaattaatgtaatgagtagtctactatgtatatatcttaaatttgttgtagttgacttattttgtatatgcttcttatggtagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcaggtaatgatactgaagaccccacacttgcaatgcaaaatgttttatttattgtatttgtgtattagctattattagcactcagcaagtcatagtttgagtgtcatcagcctctctcccttccctttcccctgcctcccttttatgtgcattctagggtgaattctactgacattttgcaatttacagtcttacacactggactctgagtcaacttgtcctaatcattttattttcagattccttttataggattgactttgaaatgttacaagttgatcttggtctgaaagtttggctctgctgttagctgttaccagagagaaaggatgaaatagatgctaaatgcaatatatactgtgtgatatacacatcacatacaaatatattactatcctattatgctttgttacttctgtggagaggggaagagaatgagaggtggggtggggggagggtggaggagagagagagggttgtaattatatgtatgttggacatgtagatgtcttcctgaggaaagagaaccatgcaaatcctaagttacttccgtgcccagatttcatatttctttatcagcaagcaaaaggacatctattatttgcatcatttagtccttttggtaaagtgaattcttacttcttaatttgagttatagctgcagctatcatgtatctttctctgaaatatttttcatatgaggaaaacctaacccaagtttgcctgcacaccaagagcatgtcctcagagaaagtgagcttcggggttagttggatactctaccatgtcattttggcttagattgtttccatctctctactttgccatcacaaaattgactttcatttggttgtttgaaagctgatgttattgttaaggttactatgttctgctcatgttcatttggggcagagagagatattttatgagattctcaaagtaaagaagacatttcccaaaagactctagaaaatggcttatgtctcattgtccagaactgggtaacaagcccactcactcattcattcattaattcatgcagcagttatttaacaaatgcctgttaggtaccagatactgtttcagatgctacagtcatgttagaaaataagacggtaaaattctttattttcatggtccttaaattctagagagggcaaggggagaaaggcagtaaacacagacataagaaaatatgtactatatctgatggtgatgagtgtactatgaagaaatgttaggcaaggaaggcagatggagaatgcaagggagggagtggaggttgtatgtggggaaatctaaaataggatgatcagtaagggctgtttggaggaaatgacagaatgacaaagactggtgggggatgagggtgtgagctatgtaatatctggggtaggaacatttaaagcagaaggacccatcagcaagagcaaaggccctgcagtgtagccctgcccatctggagcaacaaggaggccactgtggctgatgtctgcatgtgataggggatgaggttcaacaggtgcagggccagggctctgtgtcagggatccccatgaccacccacagtttcgatgagtcactaagaagactcgcaggacctagcatttagtcatatccatggctatgatttattacggcaaagaatacaaaataaaatcattgaagggaaaaagctcatggggtgtaaagtccagaggaagccagggcaagcttctaagattccccctcccacccccatccattgacacaggacacacttaattccccagcattgagttgtcacaagatgtataaaatgttgccaaccagggaagcatactagggactcagtgcccaggattttaactggggtctgatcatgcaggcaccctctgcctggcacataccaaaattctagactctcagaaagaaatgaatgttcagcataaaccacaattattacacagtttaggcactgggagccacttaatagttccagaatggtgggaactctcctgaaattccagttcccagacaccagcggatagccgacctgtgaacaagcctttaaggatagcagtcaggtctgctgtgtgaacactttcctgcataagcccattagcattgtaatgagtttgggccctgagggaattagagagcctttgaaggggaggagtagaaaagtgaatgatctgactcacattttagaaggaacaactctgaccatagtatagagaatagattgtaaatgggcaaggacagaaatagaccagttaggaattattacagtaataaatgatggagctatgggaagcatgaatttgctgctcattgagatatggatgactataggaagagcaggtttaggggataagatgaggagttttggatgtgcttaaagtcttgtgtctgttgcatgcaagggtcagaagtttacactactactcaatctggtccattcctggagctaagcgtagtagatcagcttcctctgaggcatctctgcccaatagggatataatgtgtgcctcatatgtaaatttaagtttcctagcagcctacattttttaaaaagtagaaagaagcaggtcacttgattttaatatattttatttaacccaatgtatctgaaatattttttcaacatacaatcaacataaaattattgaggaaatagtttacatttttcatatcttgtcttcaaattttagtgcgcattttacacttatagactagctacactaactacatttcaactggtcaatagccacatgtggccagtggctactgtgaaggagaaggcaaccctaagacatgaactgggtcttgagtagggagagttagaaagaaacaagaggaccctattcttattaggtactcacttgtttcttcactttcttcagatctctgcaaaatgataccttaccagaaagatcactgatggaaaattgcagctccccaccatcattctgtatctttttatccttataaaaagtttcttcatgacacttataattgcctagtttgtctatcatcaagtttttttttgttttttttttaactagaattgaagagtatgagagctggtatactgctgtgctcacagctttatccctgcacccagaaaagtgcctggcacacattaggggcttaggatgaacctgtcattctgtgggagaggcagaacacttacaaggccttctcaaggccttatacaactctatagggcagagctgggcttcctggggtgagaaccgacatgctctgctgtgtggttccatcttctcaccctgcagccttgcagcagatggagagcacatgctattcctcaactgtttgagaatggtagatttccctttatgaagcttgttccaaaattgttctggagacatacaattactgttattcaatacttgccaatagatactgaattctttcaatctgttcagtagaattcttcattacaggtctttgatgtctggacaatctcatttcaaaatgagatatagcagataatgagaatttcttgaatattttctggctgcatgaagtgctcattttattaaccctcattgatggagggcatggagccagagagagctggctttttaaaaaggcattgtcttttgtgaataaattatgtgcatattttaaaatcaaggcattttatttaggaatgtttgattgcctggagcaagattttattactatgtaacatctgtaacaatgtgttaaaatgctgtgtaaaatattgctaaaggataggatcgctactcaaattagcattctaagtaaaagctctcataagttttaagaaattaatgggggaatctcttttcaggttatcatagtgacctgaatgggaagattttcaaaaatctttacactccatattcttgctttactgcatatggaaaatccaggggtattgtaagaagagattctttgaagcattcattttgaggaacagttcatgaaatggctgacaagagacgttgtgtatgtttggtgaagaatggtgtagtcacacagaaacagataattagtttgggacaaaagaaagaggctaggaagcatagataagaagaaagaaagtaagtaattctatcataagggaaagggatatttcaggcaggaaaaaacagttgtaaaggccatgagctaaggatgaaacaccatcaaaggaggcagaagagcccacagaaacatttccgaggatatgaatttaagaataagagacatttgccagtgatcaaggagaaagctctaattctcatgacatcgttgtgcatggatgggatgttggaaaccatataggtcaagctcttcttttacaaataggaaacaaagacctagtgggattgccagaagttacacagaggaaaaaggcttccctactctcctgactctatatccgttctcttctacaaactttttacatgctatgaatacttttacaaaagtacacgctttctgagtatgaatgtaatatatgttcactgaacaaaatttgaaaaatatagaaacagaaacataaaataatcctaaaataattaacatttttgcttactttcacttagtctgttacttattcaaacatgtgtgttttaaatcatggtcattctatatgactgttttttaattgtcgttttcacttactatgtcatgttgcttaggaccacaaagtttgcaaatccataataacatgagacaaaaaaagaagtctgattaggtaatttcagggaaccccttgtgactttctgtgtattttttcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtggtatgtaatttacaaagttataggaaacacttttaaattatggttactagtgatgtatgggaccaaatcctgccttatggatgaagtgtttgagtttgaccatatcaacactgaattcctactaatcattgtagagagggatacaatttaaggttagttttctggttgtgggtattgttcttttttaaaaaaatataaaaccaaaattgtcctttaaaaagtcattctttctgagtttcagtacattcgttggccacattgtgggtgcattacattgttagaaagataaaattaaccaaataggatcaaaatgtggtttccaggtttaggcacaatggaagtagtaagtagggaacaagtctgtgtaaaacagtcggacttatgaaaaagtagatctgagttgtggagtgatataggttgggcttcctgtaaatagactctgagattgagagttgtggacagaaggattttggggagatacatctatgaggatgtgaggaaggtgaggatgtgcagagggagaagttgatccacaggcaattgcaactgaggttgattgcaactgagttcaggagatgagctggtccttaggagttgttcccagtttagagctaagctattgatatccccattttagcagtccttggctttaggccaccctcagggttgggtataaccttgagtgagacagtttgctgtaggaaagggtgattcccaatgaggagcacagaacctgttgttcctagcagccgagggatgggtacatcagccccaagaagggatctgggcagacgacgagattatctattactggagaatagtataaagttggagctgaggttcaagaatggaataagaatgagccaaataagtacatgattaacaacaagagggatcagagagccttttgttcctagctggaagatgggttgtcttcttggcttgcctttggtttcatagattagtctgtgtatatggcccaaatgcttctctgaagagttcttttaaaggaactctcatggaactgtctcaaaaaaaggacaggtatatatcatggttcatcatttctaggtttctgtattatttcaaacgtgattggagcttctgtatattaagaatgttatagcaaattctattgcatttaatatttactttaggtaagctaccagaactgtaagttgtgtctgtcaggttctatatgttctgatttgtgtttctccagttatcatttcttatataaacatgattacaattatttctaatttaaatatataatggtaccttaaacatagactatagtttggaagaattaattatttcattcagggagctagtatatcttttttctgtaaagggccagatagtaaatattttaggctttgtgagccatttggtctctttcactactgctttgcctttgtagtagaattgtgctaggcaatataagcaatattagcagacaatataggcagcgatagacaatatgcaattgaatgagcttggttgtgttccagtaaaacttgatttgtgacaaatgggtttggccattgggcagtagttttctgacctctgattttattaataaagctcttgaatttatttttttaacttttattttaagttcaggggtacctatgcaagtttgttacataggtaaactggtgtcatggggttttgttctacagatcatttcatcatccaggtcttaagcctagtacccatcagttatttttcctgatcctctcccttcttccaccttccacccttgaataagccccagtgtgtgttgtttccctctatgcgtccatgtgttctcaacatttagctcccacttataagtgagaacatgtggtatttggttttctgttcctgtgttagtttgctaaggataatggcctccagctccatccatgtccctgcaaaagacatgatctcatttttcttttatggctgcatacctaaagaaagaaataccattcaatacagcaatcccattactgggtatatactgaaagttatataaatcattctatgataaatacacatgcatatgtatgttcattgcaacactcttcgcaatagcaaagacatggaatcaacctaaatgtccatcaatgatagactgaatagagcttttgaatttatattctccattgccttttccaggtggaaaaacgaatgtcagcaaaggtagatacatcagcctataatgctagtttgagtaattataaatagtttgtagctgcattgctggagagtggtgtgtgaggtgggaatcagtgaaaaatggcattcaagaagtcctatcagcaaggtcttccatgctttttagcaaatttggatttgactctttagacaggagagacataaaaggagaagagagttgctatgatttgtatctctccctatctttctctctccacctgtgttttagttgattcattgcttagtgatacatctgttcagagttagtcaaaggaaataatccgggcaaaagttttgcagagaaaaatctttaagctagtatgccaccttattttacttttatggatctttgtatatggtatctagaacttagattcccagagagactgtatactttatcttagaatggaattcagtctccagtatttgacaatttggctgcatttttttttattagcttaaagtttataaatggtttgctcttcctttttcctaacaatcttccattaatatgaaagacatctgatttgtagaatcatattattatgttgcttaaatatctcttgctatttaagttataggtttaataaaagaaaatcaatttttaaaatattcttactacatagtgacaattacaaaataaataacatcttctttctttaaaattctagattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaaggtaaatattgttaaatatctttcaagttttaatgagaagcttcattggataatttaattctaatatttataaggaatgtaaatttctctttttatatgactttttcagtttggcaggtcatactcaatcctttttgtttattgttgttaaatctggtaatcatgtgaaattacctagcagtaatgttataggaaatgtgtcttttaaaagatacattatattagaaatattaatattttagttgtgagtacagtagaggtgactgttttttattttactttatctttttcatcattcatctgttctctttcttcactcagctatattttctatagattttcactagttacagagaacaatgagcaacacaatgaaatgtgtacatggcactaaaggtattaattgtttaatccaaaatagtaattagaataattttatcctgtgaagtgtacagtggtcaatttctcttttgagtactaaaatcatcacccaaataattattcatattagctgctggtgaaggttctaagattttcacgtaataacatggacatccagctttcaagtacctttcatttgaatagtcaatgggaaaaatacaacatgtggttatgttcctgggtctttaatatggcaaattaagtttttaaaatctaaacaatgaaataaaagttaggtgctgtgaaatactttgagcctcctgataggcacgtcactgtaagaacaaaatcactcttaatgattagtcattaaatgactttgtatatataatttttcattttttgaagaatcttttgagcctttataattatcatctctgttcaacctgcatatctgtacttccctaagactttgcagcaatttctgttaaagtgtatgacatgtgcaacataggagggtgctttagagaatcagaagtgggggattagaactgggatataatgctaggagtggatggtgattctctgcccaactttggggaccaggaagaccaagcccagaatgatccttgggagtatacattgtctttgttttacttctttttccttaactgtctacaagggatagagtagagtgttccactctaggtccttgtaacagcattgacagcaaatagaaaagactatttactcgtggcatgtttctctcacagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggtaagtcaaggctgcaaagaatgtgatctaaaatagaggaaaattctcttaagtaaaattgtgatgctcttgtaagtaaaaatcttttttttaataaaaggattcttttaaacataaaaatgtaagtattctactgttgccacccacctaagtatttaataatgaataatattttataactggctggcaaaaatgatgtctattacttgtatttattcttgaactggaatattgtttgaatgaattttgaagcactgaatttagattaattatatctgattggatccactgtaattttgttttgtcagtttttaaactaatgacaacaagtgaaatgcccaaatcaatctggttatttttattattcatttaataggacagtattttcctttcatgatatgattacttgaatcaagattagtcttcagatggtttagatctggttttagctatctgtatttatccatgtatgtatggagagagagagaagaacagagaaagagagggggagaatatgtgactatatcagtaatgatgcacaagaaattttaatagtggattagtgttaataatattataaaataataacaaaatgttgttttatattatataaatagtattaatcttatatattatataccatagaatatattatatgttattaaataaatatgatattatataatgttagtgttactaatagtggtattagtggttttaggtaatagtatctcctgaagagtataatttgggaaagatataagggatgggatagaaatgagggttttccccccctttttagagtattttttatctctggaaatttttcattatgcaaaaacaaagtaagaaatttttaaaaattaaatataggcttatatctagattttcaagtctagagcttttgctttaaaaatgtatgtagcatttaccagtgtttcctaaattttcttttgggatattaaatatgtaaaacatacaatagaatatggtcaaaatttcaggatagatttttaaaaattattttatttgctaatgagtgtgaagattccattgaaacatcaccagtgagctagaatattctatagattctgaagtggtcagtgggaatgtattaaaatataacaagaatcttttttatgtttgacagagctgcccattcctgtgaacaaagtcaattatttccttactgaaaaatatcaagtattcaatgcaagttaaatgtcttaaaaaaaaatgaaacaccatctttttcccccatcccccaggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagagtgagatgaactttcatttgtttacagtcatacagaggcctctccctgctgatttggccagtgttttatgtttagctttgcctgtatttatttttaaatagataaataaccaaatttgtcttataaactaattcttaggtctctttgggctagaccaaaggattcaacaagtttactttcattaaatataagagttcagaagaccttttatgcatacttatatctgactattaatttctactttaaagggtgaaatatagaaagttaagtagaaacaataactttagaaagatgacttatgagagttaccattttatcttgcctttcaattatattctttacttaaagggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggtatgccagtcattaacatattagcctttttgagttgtgcttcagacattttgtaggcatccatcaaatgaatgtacattggtgattgctaaatgcattatactctaaatgtttctatgttaagtcaaacaaatattattaattgaaatacaatttattaatgggcataggaagagacttataaagatacaacaatcttacccttttctgaacccccgccccagttttatttaaaataaatagaagttacaaaacaggataataattgacttagaagtgcctaacaatgtatagaaaactgtctgatgaactagactcttcctgtggactttagtttcttttatcttttattttgtttcttaatgccagtaaatatagatatttatttagaatttgcactaaaagtgtggacagtttttacttaatatctaaaatgccctttataattaaaaaaattgactaaaataagagaaaatgaacaaaatagttaaaacttgaaaaattgaaaaacaatattctagatttaggctaaccagtcttaaatattataaaacattccccaagaattacaaattttgtaaacttggcattttgtaatatgtaagaataagatgttttcataccatttttttatcagtaagtggaaaaggcatatgaacaaccatgaaaatgttagtaactttaactagcacctctatctacaggtagccttattttggctagacaaattaccagagtatgcgtcaacttatttgttgctcatggggggcggtagtaaatgctgttaaaaggtaagcatacagatgtagattttcctacacagaaaaacccattattgttaatatttttgaaatcctgagcttttaaagcagatttagaacttgaaacatttcctaagtaaaaagagtggaatgcaatcccagcactttgggaggccgaggcgggtggatcacgaggtcaggagatggagaccatcctggctaacacagtgaaaccccgtctgtactagaaatacaaaaaaattagccgggcgtggtggcgggcacctgtagtcccagctattccggcgactgaggcaggagaatggcgtgaacctgggaggcggagcttgcagtgagccgagattgcaccactgcactccagcctgggcaacaaagcgagactccatctcaaaaaaaacaaaaaacaaaaaaccggaatgcaagtcaatgagattcttatgttaaaagcagaaacaaatacattgattattcattgaagcagcctttcaactttaatgacattatcagcactttatctgtgcatgaggttcaagttccatcattaaccagcatccataggatcctacttattcttaaaattcacatcctctagggaagggactctgtattctacagcacagatttgaggtgcaggcaatttaattaccttctatttgagcatttgattttattcatgtttctatctgtctgagtgtgatatccaggtttttcacttttctctgttgttaaattaaagattttaggtagatttaatttcattttctgataaatgtctgtcagaaacattggaatatttttatgaccaatagtgaaactgcaagctggatcaagttttatttatttatcagtttataaaaacttttaacatagactcagaaaattgaactaaatcctgattataaacatccaggaatagcaaatttgggttttctttctgcctttctttttgactacgttgcaagaacaatatttgaaaccaatgggatttattttaattgtagaagactggtaatttttatgtaagtttcatatcatgtaatattaataccaagcatactgcattttatgtttgtgcaatggtgttagaacctgcatgacattaaaaaaattttaagaataaggatttattgtttttaatctgtaaataatactcttatcacatcaataatgttttatcttgaaaataatagactgtaaatttctgactttgaaataccataaatatacacaactttaaaatgccataaatatacatgccataaatatacacaactttaaaagtattacaaatataatacgcaaaaagaactactttttagtaccatgtttctgagatttttggtttcaactaaaaaattaaaatatatgtcagcaaaaactgtgattacattatttctttcctcatttcctatcttcctccttcttttcctccctctctttctcccttccttcctttctttcataggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaaaaaaaaaaaaggccgggcgcagtggctcatgcctgtaatcccagcactttgggaggccgaggcgggcggatcacgaggtcatgagtttgagaccagcttggccaatatggtgaaaccccgtctctactaaaaaaaatacaaaaattagccaggtgtggtggcgcatgcttgtagtcccagctgcttgagagcctgaggcaggagaatcacttgaacctgggaggcggaggttgcagtgagccgagatcacgccactgcgctccagcctgggcaacagagtgagacttcgtctcaaaaaaaaaaaaaaaaaaggaaagaaagtcttcattacccttcatgtatgagtctcttctcaaggatcttttgagtggtctattgaattaagggccaatcctccagcctgtgcacacagtttgatagtaatgtgagctcttaatatcaggaaattacaaaggggaacagattcctatttattggctgtagtagatcaagatgtacttttcatccataccacctattctctgcctgctttactgccagaccaccaatctggtcacaggcaggattctgtcatgggtctgggtgttacatcccacaatgggtttatctggtgagggatttatattacccactgttatgctagtctgttgtgacttatgtagaaaaaaacaccacagtcaccccccacccagctcatgtatttctctatatttcttctctcttacttctcattggctgtttacttccaagacttgaaagaaggaacccaattattattgattcagccacaaagagagagagagaaaaaaaggctaattaatcatgaaaactaagtatttgtgcagccatatttggtacctagtactaaattatcactacatcttaagtataaaacactataaattccatcataattgttattacatgataactatgacataatattatgaccttacctttcaaaagaaattccaaggtatgaattagccataaaaatatttagataatccccatatactcagcaacttttccggccccatatgtcaccattcccttcatttaatcacttataggttgtcagtaattcacatagatcacttttaattaataaaccaattgctgaaatgcccattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctacttttactgttagagaaaatgaagacctacactagtattcataaataatttttgttcattttattgtaactgcggtcataaactctagtgttttaaacctagtgttaagcacacttgttctgggaaataatatcgttacagctacaaattttcaatttgtcttagagtctaaagggaagatttaggttacccaattcctactgtattgttgaatatgtaaagcatgcgtgcttgagctttaattcattagatgtccatggctattttgattgttgatgataatagtagctgcatgatgctcagccctttgtgacttttttccttgcttatatcctgtctttcctatcacaaaagtttcttggtaacatgaagtttatcttttaaccttaataagatatacaatattgtgcacacaataaacattctgttagcattattcggtgacacagattagattcacagctgaggtacattgagaaaagactgttagtataaatccatcaaaattaacaagctgttcacaagggcaatgtggttaagtataccaaagccctgagaatagcagagacccatggaaatctacttgtgaaacctaaactaaaatgttacatctatggaatcaaagaagacttatataatggattttctctatttttttcttactaaatttcactggtccctgaggagtggtatgaacagtttggagtcaaaataccctaattagactccaggctcctcatctccagatatatgtatatatctggccctcagatttctatgagtttctatgaggcttaaataagataaggtatatgtaagaactgacacacaatagaagctcatttcagtttgttttaaatctgtgctgttgacatcaatgcaaatctcatgaagaaaacaaaacaagattgtattgcatgttaagcttctatccgtgttgaaagtggaaagcattgtgttatattttctgtttgtatagcggatggatgatataggttcaatgagaactttgcttcacagagtcaacatatgtacttcacttatactagatctgttaataaggacttgtatgcaaaataaatagttctggtaaatcaatgtattgaatctcctctctttatctcagattaataaaaaccacttttaaattttgactcgctaaagtaggtacaccataattcagaggacagtttaggtctgtattatgtgaggagcctgattgtagtaacaaagatcccgccaagtctcagtttcttcatatggtaaatgtgcatttcttcttcacgcaggaatcctgcaccagcgtgcccagttggctgatgcttatggacacctcttattcagctggcagctctcaggccctagactctgtccatcttggggttatgtcctcttctaggtcctgggcctcctctctattcacctgccaaatggaaaagtagaggatgtggggtcttgtgtgggtgtttatggcaagagtattagcagcataaatcatttctgcctctattctctgggtcagaattcagtcacatgctctacctaattgcaagagaagacaggaaatgccaactagttgagcatctaggaatagaaagtgggatttggtaaaaaaaatttttctgccacatgataattacatgtaacattctaaattataaaactgcagtcattgtaaacagaaataagattctacttgtttatcctgctctttttgtttttttttttgtttggccttactgaattttcttctttcaggtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgaggtatagtcagcattagcactcctgtaatttttccccaatttgtctttgattttctttttcctttttattgtaaattcagggagcacatgtgcaggtttgttacatgggtatattgcataatgctggggtttgggcttctagtgagcccataacccaaatagtgaatatagtacccaataggtagtttttcaacccacaccccactcctaccctgctgcctcaagtagtccccagtgtctgttgtttccatctttatgtccatgtgtatccattgtctggctcctacttataagtgagaacacatggtatttgattttctgtttctgcattaattcacttaggataatggctcctaattgcatctatgttgcttcaaaggacatgatttaattattttatatgactgtgtagtattccatggtgtatatctataacattttctttatccagttcactgttgatggacactaaagttgattccatacccttcctattgggaataggttgactgatgtctgatgttgagtggaagcacctgccctggtgtgggctgcagggagggaaggatggtaaaaagcgatcatgttggaatgtattggggtctcttggggagtgataagggggtgtaccaacttctagtcctgagccagcaggaatgaagtttgcttccctctcgtgcccgtgttgcaggactcatgactcaattcataaagactttgtcctttggctctgcagtgcagctgcaggccacagatatgcccctctaggagctgttaccaaaatgggctcagggcaaggcctcttccccaactccagggcaagcaacttcacaacttgtctgtccgccattgctgggacactgctgctctgtctaaaggcggggagttgggccctgttcttcctgtaagcccaagtggcacaagcttactttcagcagggattgagccactgaaaaaagcacacacaaaaaatgctttctttgtgtgtatgcactaagtaccagtgggaagaaccacagctgtgtctgcaacagtctagagtgggagatgactccctctctacgactgtccctaggcattggtgctgcccccttcagtgactggccccatgcctgcatttcctttgtcccaaggggactttgatgggctgtgctccccctcccttatgggcagcctacactgtgggtttagatcttcagaagtcctttagccccctgggacccacctgtcccccatgcttcccaacgtcagagccagttgtggggtatatttgcaggagatctggtggtacagtgactctagagcagagagatctcaggcagggcagtggcactatgggtacacaaccagtatggcaccctccatctcattttgggtctgagggaaacataggtgtgcctgcacaagctagcaacctggttctctgtccctgggaagttcctgaatagccacttatagcattgtcttgggtcactagcacagaggggctccttagaagcttggcagtcaggagattgtcagaggagtgaggggaggagagaagcactcccacctactttccatggggctccaagctccttgggggtcaatctctgtggactcttgctgcttcccttttctacaccctgcttcttcccactggccctctgacagatcctggctctcttcccccagttttctgttcagaactgggcctttcaccagtaactttgatcatcttcctgaggagaactggcacctgatgtccctagagagccatctgctcgaggcactgggcactgtgcactgtgctgtcactgctgaggggaatggtgactgtagtcaccctgtgtggccacacctcgagagctgtctttgattttcttttgcatagtattacttgtaaattcatgtgataatatttactatgtctgggatttttttggaaatccatatgcatgatggggggaaaaatcacagaccacacacacacacacacacacacacacacacacacacacacaaactctagatatctgaaatcaaattttttttgaagtttttattgctacataattgatatacgtattttcagagtacatgtgataatttgatgcattcatataatcaaatcagagtaattgagatatccatcaccttaaatattttttctttatggtaggaacagtctaattattctgcagctgttttgaaatgtacaatagattattgttacctatgtcaaattctttttttttgtttgtttgtttttggagacaaggggtcttattctgtcacccaggcagtaatgcagtgatgcgatcatagctcactgaagcttcgacctcccggctcaagcaacatttccaccttagcctcatgagtaactgggactacaggcatgtgccaccatgcctggctgtttttttttttaattttttaaaaatttattttattttattttaattaattagttttttgagacagagtcttgctctgtcacccaggctggagtgcagtggcgcgatctctgctcactgcaagctccacctcccgggtttacgccattctcctgcctcagcctcccgagtagctgggactacaggcgcccgccaccacacctggctaattttttgtattttttagtgagacagggtttcactgtgttagccaggatggtcttgatctcctgacctcatgatccgcccgccttggcctcccaaagtgctgggattacaggcgtgagccactgtgtctgatctatagtcaaatttttaagttcagattctgcccctgttttcccatcaaaactacccctctctcacatttttcctcttctgattgaaggcaaagccaatcaaccacgctggatgtctggatatcatccccagctgcaccctttctgtaatcgttacatgtatttggttaccaagtctagtcagttttccctttaagtgtgctttctgactattctgactgtggagaacttctatactgactcaaaatactgatggtgtaacataataagacaatgtcaaacttacaaaaacttgtagtttttaacatccatgtacactttgaaaaaaaattaaggaagtatttcagccaatcaaaaaactgaaacacaataagtagtttgagaataacaagcatattacagtccatctttatgtgtctcagcctcccacagtgataagaagtgaaggcgcaaggtcctatctactttgaagggggaacataatcttttggcccatggagttggtttctgtaacttgtaagaatgactccccttttcaaagtttggtcggacatttacagatctgtttctttatgtcttcatcagcatgagcctgagaaccttggctggagtatcaaccaacccactgtaggatgcgatttttctggttgcctgtgtgcactcaagtttcttcctcctctttcccttctttggctagttttaataatcaaaagaaggtggggaagcagcatatggggcccagttaagctgagcacagagttgtttttaatgaataattccaacctaaccacaggacagtggtatttaccagtcaaactcctaagtctttttctggaagggaggatggggaggtggaagagacaatctgattataaaatatacatggaaatacaaaatgccaagaatagccagcaactcacaaagaagaatatggagggtggccctacttagccaatgtgtcagataatacacagttaaagtaaataaggcagtgtgatatttgctctgggatgaacaaacaggccagagagaagaaaatagtccagatttgtcagtcgttttatagtttttgcttttagaatcatgtttgattctaaacagctttcttaatacctaaacagctttcttaaattaataaagatgaaaccagaatgcaattaattaaaaaacaaaaataccaataaaacctgattcataaattaaaaaacttagaaaataagaattgacgagaaggaaataattattaaaagagaaaatattgaaaattgtaagagactatataaatgtcgacaaataaattttaaaaacctatgtgaaattggctctagcagatatacagcagatatagaaagtctaaacctatgcacttttgaaaatgaatggagaataaacattaaaaacattaaaagctcagtaggtggttttccaaaggaattccaccaaatatgtttacatggtccatgtcttactttttttttttttttcagtctaatgactcttcttcagagccttcaacatgagatagcacagaaacgaataccttttttcccttcggtattgcaatatgtgattaaggaagtcatcagtgatgccctctggcagtctatttgccatgcacatgttctgccatcattcttgaggtgtgattaccctaatggtattaaatctcaatcaagatgttgcaggaatatcatccgtttacttctcagcttctgacacatgatgactcatgaaacatctaggttgtgtgccctagccatgatctgaaaacctctcacctgaggagcatttagaatttagaaattagtttcaaatgtctataaagattttcctcagtaataagaagcaataatttcccagttaccagattcttactgctagatacacttcccaggtgattaaaaaggttttcttgttttgagcataaaatctacattaaaatggcaaatagtctgatcttttcttccagcgaataagttcatccatttttagagtactgcattaggaggcatggggttgtttctagattccactctctccatctgcttgtttggtcatcagcctggtacatttcatgtacaactgtgtaacggctccattgtttttatatgtctagttctgaatatatacaaagatctatgtctcccacgggttctaatttggttttgaggatgtctttcatcatctctcagttctacttatggctagtggtatccactccatcaataatgcccaggtggaaatcgttctcatagcaacttagtattcacattggcaataaggaaacctagtctacagaagctgttatacctacggtacatcccaggttgtaccaatacttactgtataatagtttcctggactttctcaaaatgtagcagtgactgtggagtcaccattgcccatcttacagggaaattctcacaataattctgttcagtcctaccttggtaacagggcaaagtccttctttcctatttctactttatgcaggacaactaagctccatactttgtttatagaaacatacaactctccggaactgatgaatggtctataggtgatgagtcagggggatattgcactttaccttccttggggagaaaattatgaggtggagattcgtgtccagaggctttttaggaagtgctcttgaggtcaacacctgtgtaagtgaaagaagcaagattgggcagggatgaaggcaaagcatgaggcagttgaaactgatgctacagtatactacagtttgttttgaaatgggactgacccttcagagctgtctgagttagaatgatggtgagttttataatcttgtgttgagcagtcattgtgtatggaccatgccaggaagagcatttgaccatgtgagaaggggttgtcttcagatgagacaatttgcaaaggagcctgtcagatgagggtaataagtcctttccagaaggggaatcttagtgaacatcagagcatccaccactgagatgcagggtacagccacgttcaagagaagtttgttctgaaaagctctccctctctttcccttggtcttttatgatataccttattttttcactgcccactttgactctttgccttctacccattcctgtttccttcctgccccatccactgttgttggtcccaagagtactccctattatgtctttcctctcttgtctttctcttagcagagtaacttctagaaactttgttaagtatcactgtaggctggtaaaaataaaatggtcctgggaagataagaggaaagaaatatacagagaacaactatgccaatactttgagagagaatcatgatgcatatcatttttatctctaccttttcctctgcattctaaaacaacttgaatttgtcctatgcatcactgattaaattttctgcagtttgaattctgtattttattgtttctcatgaacattgtagttttgcaattgcattttttctttgagatttttattattaaatagtattattttaatctcttcactcaagcttttgtttcttcatagttgcttattgttatttttaaaatatatacatttaaaaaattttgtaagggcttctaggaaaatatgtgctccctgcctgagacctcattagatgtacttatgaaaaatctgtaattctgggatgcagtgcatcattcccattccttttactctctacatattacgaattggaaactcagaattgatataaagatgaaagagctgataacagtgggaacactaaagctctgaggtaggtggcagccagttattcttggttagtgtagtctctgtggcctggagttcaaagaagtcaggaaatgggtcttacccccagtattagtttgttctcacactgctaataaagacatactcaagactgggtaatttataaaggaaaggaggtttaatggactcacagttccacatggctggagaggcctcacaattatggcagaagatgaaggaggagcaaaggcatgtcttacatggccacaggcaagagagcgtgtgtaggggaatggtcctttataaaaccatcaaatcttgtgagtcttactcattatcatgagaacaccactggaaaaaacccacccccatgattcaacacctcccgccaggtccctcccatgacgtggggattatgggagctacaattcaagatgagatttgggtggggacacagccaaaccttaacacccactttgtggtacttcttgttatttaggttcatggcgtggaatgtgtatcctctagtctactccaaactgattccttcattagtgaaattttacctgtattttagaaagattttaatctttagtttctttctttctgttagtcttggccctttatggtgtctacatgtgcatttgaagaaggcacaactcatgcaaccagtctctgccagtttaactcagaagtctctttcctacatctttgttttaatttgctgtaaaaatatatgtgctcatggaaaacaaacaaacaaacaaacaaacaaaaacaaaaaaacctcagtcagtacagaaggatgtagaaaaatgagtaaaattcccctgactccttctgaatcttatattcctacttcccagaggtaaccgctattgacagttttttatataccctttgaaaaatttttatgcgtatccaaacatatgtgtcttattcttacacaaatggaattttacactgcaatctgttcagtaacttgctctttttactttataatctatcttaaacatttctttttcatactagctaaaatccattgcactaaaaaaattggttacatatttttcattgcatagattccccttagtatttgatactattgacatttcttcatgagcactgttttactgtggtgtttatagttctcttacattttttatatctttctgggattcacatttcttgtttagtatttagttctgtctagttctcctttcccaaatgtttatatacttttgcagacttccatcacctatatttgtattattttcctctcctttactatcttcgcaatcttggttctcttgagatatgggaagtagccactgaaaagtaaaaaggatatagattttatagccagctagaccttaatccaaatcttcactctactgtttaatgccatgtgactttaggaaaattaatttctctcacatttgggttctttgttgcaaaatgaggataataaggcttaatctaaacaaaggctctgagtattgcatgaaataatgtttgtgaagaaactaaccaatttacagacatttagaaagtgttttatacaacaactgtaatttagaaacattttaatgaaatagcaggttgctacctcaacttaatatctacatcataggataaaaattaaaggctttaaatttttaaaattcaacaccttttctacatcatagaataaaaaattaaaggttttaaattttttaaaaacaggaaaaatttatatttctattttcctgagatagcctatatatagtaccatttctcaaactgttgctctgcactgctattcagcagaatagaaataattgttctgaattttaaagaaagaaagggattccaggttcacatggacttgggaaaaccttgattgagctaagtaggctctttctatgcaggattatttttagacactttaatatactgaattccattttgaatctctaatattcggaatttattcccctatgaaacttccccatcacctttttatcccagaacatttattactatctttcgtaaccattggctgggattttccacctgtaatcacccttttcccccctcttactggttgtagatttctttgagaaatgaagagcatatgatatgaagagctgccttacatatacagtagataaggtggaaggcaatataaacatataaaatatagttgattctcatgattcacagtagccaatccttatcattcacaatcccctacttgtgaatttccctactcactaaggtgtatttgcaacctccaaagtcgatacttctggtgttttcatggtcattcagggacatacagaaagtgttggagaatttgattcacctgatttgtgcatttccagccgaggttgaagaagccaacaccttgactttgtttcagctctcatgttgtaaacaaatgttctttttccagtccatttattatcacttttttaaatttttgtgctttctgttggtgagttttctgtttaaatttgcccccaagtatagtgctgaaatatggcgttcctaagcacaagaaggctgtgatgtaccctaagtagaaaatatgtatgttagatgaactttattcaggtgtgagtcatagtgcttattaaacatgagaaatgtatttgaatgattctaagtttttgccaatatgtacatgtctgcaaattaccacaaaagtgctcaatattgattttggggttacaaagttggatgagtagacaaatgtgcaaataaggaatccaagaatagaggaaccaactgtatataaaatcagtagcaccttggagaaattactgtacatataaagaagtatgtaaagatgtttatggcaatattatttgtaatagtaaatagccattgtcagataaatcttgcaaatagtataaaggcaaacaatggaatccccacagcaatgaaaataatacattgagtctgatagcggtggctcatgcctgtaatcccagcattttgggaagccagagcctggtggatcatttgaggacaggagtttgagaccagcctggccaacatggcaaacccccgtctctactaaaaacacaaaaattagctgagcatggttaacgcacacctgtaatcctagctattcgggagactgaggcaggagaatagtttgaacctgggaggcagaggttgcagtgagctgagatcgtaccactgcactccagcctgggtgacagagtgagaccctgtctcaaaaaaaaaaaaaaaatacattgagtctacataagaaaacatgggtaacctcaacagtgtgcattgaaggaaaaattaaggagacacagtgcattttagagtgaataatatgatgggaagagttttgcaaagggagatcgaaatgggctaataaatgggtcaaaaagaataaattataataaaagaccatttgttgtccagtagaaacaatgctgttgaccgaagtaggaccaattcaaactatgcacctgagatccaagaaaaaaaataagaaaaaataaaatcattaacattcttatgagttaccagtaatgagaaacaatgtactatgagaaagaagtataaaatacctaggaatagattcagcaagaaacaagtggaactgatatgagtaaagataaaaacaaaatcttaaaggtgaaggtaaaagaaaactgaaacatgcatataaaagaccaaggtcttagacagaaaaactacattttcttgtgaattaggccctttactgctgcctttagatatttttgttaactagaagctgccattactaatttaacatcagcaaaatataccatgaattggatatccagtgttgatgaacaacggctggcatctcagggctgtggttgcccctacaactgtgatctaatgtcattcacactttgttttctcctttgaatggagctgtttcttataaagtctatgacctttgtctgtttacatcattgtgtgatcatttggctttctttaaagattggattttcaacggttaacatttttcagtaaatttaggggttgtattcttttcccattttccccataaagaacctaagtggaatttgtattcagaactgatttttgtggagtaattctttctagctgcaactcgtaattctagtgacaaaaaagacacccttaaaaatgattatggacataaacgttattctgctaatgacaacattcaaactttggctttggtcaatctggaaaatgcactgtttctgtcattggatgtagactgagtcccagaagaccattgtgttgcacacacttcaagacacagtgttggaggaggacaggcgtttcaccattcagctgatatcaattgatgaggtagaaatatctccagtaaaaggtaagagaaattcacatttttggaaattaaaaagtaaattctcagaaaaaatgtaataaaaataacccgtagttacaaaaatggacagggttaggtttcataattcctaaaacataaagataccattttccacatgtattaaaggttaagaattttttaaattaaaattataatacccaatcttggtaaggtcataggtcaaagatttcatacagcttagctgtgtaatttttttctaatgaagatgtttattgtagcagtgtttataaaatgtaaaataaaatatgtcagcttcctaaatggtccaacagtaggagactagttaaatgtgtcagaatactaggcagccattcaacgtgacataacaggaaaaactctcaattacattaaaaattaagaacacataattacatggataattgtcacgttaagaaaacaggttttgcaacaacatgctaaatgtaatctgttttgtcatgtgcatgtcttacatgaggttggaattatttatttgaaatgttaatagtggtttttgattacctatattttctaaacatatttacaattatcacactttacctttgtaataaaacattatttttaaatgtgtcatattatgtttagcattatagcctatgtacgtctgttttcatctgaaagtagttactcaaatattttgacacttcagaaacaggcattttaattctcatttgcctccagttgatatgatgatttgttttttggatccatagagaaaagagtaatgattctaaaatggttttattgtgctataaacaataataaccaaccataaaaaactggttcagaaacttttagcatgaaaatttggtgattaatacatttcttttttgccatcaagaactccatcctatgtgactaaaagcagatttaatgtccaaggaaatttttagaattgtagagtatctatcactgtgtatacttagggtagttataatttctgcattttatttaggatattttccattaagggaatgacatcactgcaccatattcttttataagtctttagttagctttagttaactctttcataagtctttagttatctacatcatgttaaaatgacagatgtcacataggctaattaaacatagaagaatatatgattggatcaggataaatcatttaccatatcaaaaaaatttttttgaggcagggtcttgctctgtcacccaggctgcagtgcagtggtgtgatcacagattcctgcagccttgaattcccaggctcaaacaaacctcccacctcagcctcctgagtagctaggactacaggcatgtggcactatgcccagttaatttatttttatgtttgcagggatggagtctccctatgttgcccaggctggtcttgaactcctgagctcatgggatcctcccacctcagcctcccaaagtgttgggattacaggtatgatccactgcacctaattcttaatatctttctgtctgactgtgacacttgctgtgacaagccactcttgattccattaatccattgccaaagaaagtgagagtatagtgatacagctctttgtgtcatgaacccctaatatgtgtttctggaaacaattttctttaagtttctgctaagttatatggatactcaaatacttgatatagttttctatttccatcttaatagaaatatttgacacaggtttataaatgcttacagtcaaatgatagagtcagaaaattaaaaatgaaaaagtgcccccaagaaatcttgcttttgccatatagccagttgacatagctatgtagtcaattgcagtgagctgcaaaatggttactgtagaaacaaattaatgccaatggtagaggagcccttgcttttcatgagcatgatagggcaattactgccaatttttttttctgcccctttcattaaaatgtaatcttgggcaagcgatttgcctccatgtcttcaagacctcaatgtgcttcagagtcataggtaaaatgaggatattaataccttactgatatgagagtcatgagaatgaactagattcctgtgtgtaaagtgcttagaaagtttccaggcatatactaagtgcttatgtgcacctgctacaaagtggtctatatcatcttgaatttaggtagtgcatcaataattattcggggtgataagcgagcatcaggagaagttgggatagctccgtcatctaggcacatcctcattggggaaccctcagcaaaatataatggtaccgctattatcaggtaaggacttcatgatttttctttgcctatatgggggttacgaagttttatttaaatcattagtcttaagtttatcattctcaatacatacatagtcttcaagcattaacattctatatactgttaacatcctgtggagaggagaacaaatttggggcagaaattggaataatatcctgacctatcttgatattagatcatgagaaggtttctgactcttgagtgatttgcacaaattacaccaaggaaagcacatggagttgagatcagaaaatctatgttttcacctctgttctgttactaaacatgtgatataagggagttatttcatctctgcaagcttgtgtgtcttagctacaaaatcattccttagaacatcatcagggccaaacattttgctttcaagtgttctaaaatcagagtctgtattagtctgttctcacactgctataaagaactgcttgagactgaataatttatgaagaaaagaggtttaattggttcaaggttctgcaggctgtacaggaagcatggctggggaggcctcaggaaacttacaattatggcagaaggcgaaaggagagctgacgtgtcctacctggctggagcaggtggaaggggtggaggggtgctatgtacttttcaacaaccagatcttgtgagaactctatcaggaaaacagcaagggggaagtccatccccatgattcagtcacctcccaccaggccccacctccaacacttgaggtcacacttcaacatgagatttatgtggggacacagagccaaaccatatcagggcctatcatataactaaattagtatgatcataggcaagtttgtttctggtaaattttcttatgggggatgggaagcaactatcaatggcatagctgggtttgactttatactttatcctcatggtagttatccagaagtaagactatcccttcccatcagcatgcccttatatgaagggtcttccagtctttagagaacttagacttttcatattttgtaccttgcgtgttaagtgaaaagcctataaatattaatacttctttttatttctttaaaccttctgcttttagtaatcagtttttgcttgtattcctgtcaagatagatttacactagcttaatactttgggtgttactatcttggaactttaagacttcctttggtttatagtttggtaaatgaggttatttaaaagaaaactgttattgaaatggatgaaaattgattactgttaaaagacagagaaaatgtttaagaaaagtaccttcaactgaaatgtattggatatacatttgtttattgttgtagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggtatcaatattagctggtttcttttatgccctttactctctgtgctggtgtgtgcacatgtgtgagcatatgtgtatgtgtgggtgtgtttgtgtgtgtgtggttagaagtgggggatggggaggaggtaaatattacagcatttgtggttggcgtgcacgtgtgtgtgtgtgtgtggtgtgtgtgtgtacggttgacaatggagattggggagaaggttaatgtaacagcatttggtattgtggaggtgcctgtgtatgggattaagagtgggaatgaggaggagattaatattacaaaatctgttgttattatttagaggttaggagtttttcttgaaattccacagattctactgttgatgactctttgtctttttctaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggtatagtatgaaatgcttaagattttaatatcatttttatttttagatatgaaaatgttttcttgtttctattccagagttttcataaactgattaatttgctccaaacatcattattttaacatataatctatataattttataaccttatatgtaattttaacacaatcctggtaaatagaacgtttagttacagacagtattgtctggtagattaaacatccaaatcaaataagaaaatgcattttgcataggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaaggtaaaggagaaaggcaattaggaaaaagaaagcaaagagcagagagaaagagagaaagttctattgtgtagagattaatactgagctctaaagcagttctttccctactctttctcagatttgtgtgacattagaacaggacatacaagggaaattatgacaatgactgagtttttttttttaattttgttaaatataacttccctctgaaaattgaaagtatgtgtttctattgtgtggactcactctgggtagccaggaagttgaatatgataacggcttctaattggtgaagacacagcctaacagctctctaaatcagaggtcagctggtgtggctgaatttgcttcttttgatttccatacttgtgaaagggctgaagggagggatttctttcattggtgcatctgaagtctgtatcgtcttctctgtgggtgaatgacatagatgcttgccccatagttttaaagtggggaaaaatttgagtgaaagctagttggccattaatgtgcaccatgttttcaaggaagataatgaattaaccttaatgagtctctttcattccctgatttagtgaggcagatttgatgaggtggaaaaacatctttagcatgtttaagtactcacaggttctgcagctcacaggttgagagagacctaccagcatctctgcccagatagcagataggtgggcccttcaactagagtaatgcctgcatttagaagaatcataaagacatttttcttgtgcatgaaaatatttttgcctttgtaatgtgaatatcatgctttaaaaactttttaaactaaaatatgttactcagtgacttaagtgtatatcatcccatctgggaaaaaaatattgtgggctcacatacccttcaaattttagatttcccaaaaatgcttctatgcctggcaatgagagtgaatttgtactcctagtaaatatagtaaaaagtttgagctgatcactgactattttaattaaataaatgcaatttggtaaaagtagtcgtttagtgtgagatcatatttgtgttactgaccagctagagcttgaggattttgtcttctttgctactgtttttttaaaaagcagtttctatgtaagtttaattctggggaaacaagtttttccttccagataaatttctaggttttctttgatctcaaaaggtaagtagtacaattagctaatctacagcccatctcagactactggtaacagttactcttatcatttaatattctaaatctcaattttctaattttgccttttatataattcgccaactttcaacctttcaactctaggtagggtataaataccagaatagaatttgggaattgaaggaaggactaaaatggtttatcggcattttttagcatgaggaattaaagtcatattttaaagccttggaagttgaagctttgtttgatgggaataatattaatctaaaaaaagacttcttttgcagaagtatcattacagaagtaaactaccatctatattaaggatagaggaattgattatgattggtttctgtagaaattgaaatacttttctttcttttttatttttctttctttctttttctttctttccctttttctttctttccaaagtcttgctgtgtcacccaggacagagtgcagtggcacaatcatagctcactgcaactttgaatgcctggactaaagggatcctctcacctcatacttctaaatagctatgactgcaggcatgtgccatcatgtctggctaattttttaaaattagtttttagtagagacaaggtctcactcactatgttgcccaggttggtattgagagatatttcttttgaatcttgatgatttagtttgaaatttaattagtgtcatgacactcactatttctttgaataaatcatcttaacctaacactgtaaatctcaaggccgcctgcttacttacctatctctgagtgcactaggtctattactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaaggtaggttcagtcagctagcttgtaagtaagtttactaccactttccaaattacattagtttgaatttccgtgtgtaaattgttttagtttggtgtgggtgtgtgtgtttgtgtttacacatatacacttttatatttatttacttatttgaaatacattttcagttatctttgggtagtcttgaaccttactgtgaatggcaatgttaggaacaagcctgtctagaaaaactatgtttaacattaggattattaaaatgtttctgtttcaaacattttaatgaaagcctttgtaatttgtgcatatttaatttcctatgtgactagaaatcagtgaatattcacttcctaatgaataatcatctttgaaatgaatattttactggcctagagatgcaggtagtatctggatccttgatcttgctttctcgaaacagtccccagtagcagcttgcctaatattgccaattctttcctcttgtagaagcagaatacagaatatatggttatattccttcccaggtaggaagagatggctgcctttctaggaaatgattttattcaaaggcagaatatgaatatgactttaaaaataaatatcttactgctgcatttaacctgattggcttcattgcctctatcaaaattctttggttatctagccatttttaaagttcataaaaaattgctttaggagttggtttataatgagtttatgggtaagttgtggaatacatcactattttgtgaacttcaatctgtacctggaaaaaatcatattacatttttgcattaagaaataaatgagacttggaattttttcagttcattgttttctgttagattcattatctttgggaattttggtcagtgtatatttatatttataatatacattgagtattatttagccatagctaatgtgagccctattaaattatattttaatatgcagaatttagcatagcttaagaaatatatttttgaaaataatgtttaagttgaaatcaaacattgaagacacattttcagattcacaagtagatttcataggaactgaaaatgtaatcaaattgtacttgtatctggacttttaaaaattcatatgatatacatatcataaacctcatttatttatattaccatatttatatttcaattgaatgtgtggaagcaatccagagtggtttcctatgagcacaaacaacttaaatgtttttttgtatccatctaacattgtcttagaaagcaaggatcatttgtttttatgtagtacacagggagaatgccaatgctactgattaaatacattgtttaaatgctaattgtactgttctctgtaactttcaacatctgataaactatgttcctcctaaaaaatgtcatgaggttttcactaatccccctttaaaatgataaaagaactatgaaaacatagagtgcttactttgtgccattatgtttaattgccaggtttaatttggctgaatcttataagttagttgctctgtctggcttaccaattaattccaagttcccattacagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaaggttggtatatagaaaataatgtgggcacatataagacataagtattgtgttcaaactcttacatatgttttgcactgacaatagaactttagataatatgtgtccattggaaaacaacaggtgaaatacttttggggtactaggggtagggaaagaggggctaggagacgatgtggttgcatatgtcacttcatttcaaataaaggaaataatattttctgtttctctagacttaaataatctaatcagaatgtggaaacattctttaattcactttctttatgcattaagcaattaaaaagagggcaagaaagtccctacaactgccctaggtcatgtaatattgatgttaatcattcattcttttagctaagcacccacttcttaccacttgatgtgtgactactgtgccttgaatatgtatgaccaatttggaaaatgactggttattgggattttacaagcactttaatatgtttagactcacagaattgctccttcttgccatgcagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtagatttatgttccccatgactttaaatataatttttgatagactgagtatggtagtgtgttttctcattgcccaagtatatttctttattcacagccaatcaatatttattaattatcttgtatgtgtacagcagcttttgagccagattaagtacataaaaatgtataaggcatacatctgtcctcagggaaccttgagggcttgttagaaatgaagtgaatgattctgataaaattcattaattcaacaagtatttgttgagtgctttctgtgtgtcacacactgttctaggtactgagaatatactgaggaactagatagacctcatctccgttcttacagagttttcattttattaagcagagctgagcaataaacaactaaaaataaattgatctgataacagtaagggctctgcttgtaaaattgggagacacaattgcgagtgctgttggtgaggatgtgatatttcagctgaaagatgcattaggagaaagaggttagaagggtgagcatttgggcagaaggaacaatagcttctgcagaggcataagctggcatgtttcaggcatggaggggttcatgtggtcggggcctggagttaaggggataacagcacaggatagaccagagggcccaatagatgttcgatcacatggaacctcctaagccaggttaaagatgtccattgctcaatgaaataaaagaggacacaaacaaatggaagaacattccatgctcatggataggaagaatcaatatagtgaaaatggccatactgcctaaggtaatttataaattaaatgccatccccatcaagctaccaatgactttcttcaaggaattggaaaaaactactttaaacttcatatggaaccaaaaaagagcccacattgtcaagacaatcctaagcaaaaataacaaagctggaggcatcatgctacctgacttcaaactgtactacaaggctacagtaaccaaaacagcgtggtactggtaccaaaacagatatatagaccaatggaacagaacagaggcctcaaaaataacaccacacatctacaacaaacctgacaaaaacaagcaatggggaaaggattccctatttaataaatggtgttgggaaaactggctagccatatgtagaaagccgaaactggatcccttccttacaccttagacaaaaattaattcaagatggattaaagacttaaatgttagacctaaaaccataaaaaccctaggagaaaacctaggcaataccattcaggacataggcgtgggcaaggacttcatgtctaaaacaccaaaagcaatggcaacaaaagccaaaattgacaaatgggatctaattaaactaaagagcttctgcaaggcaaaacagactaccatcagagtgaacaggcaacctacagaatgggagaaaatttttgcaatctatccatctgacaaagggctaatatccagaatctacaaagaactcaaacaaatttacaagagaaaaacaaccccatcaaaaagtggtcaaaggatatgagcagacatttctcaaaagaagacatttatgcagccaacagacacctgaaaaaatgccgtcatccctggtcatcagagaaatgcaaatcaaaaccacaatgagataccatctcactccagttagaatggcgatcattaaaaagtcaggaaacaacagatgctggagaggatgtggagaaataggaacgcttttacactgctggtaggagtgtaaatgagttcaaccattatggaagacagtgtggcgattcctcaaggatctagaactagaaataccatttgacccagccatcccattactgggtatatacccaaaggattataaatcatgctgctataaagacacatgcacacgtatttttattgcggcactgttgacagtagcaaaaacttggaaccaacccaaatgtccatcaatgatagactggattaggaaaatgtggcacatatacaccatggaatactatgcagccataaaaaggatgagttcatgtcctttgcagggacatggatgaagctggaaaccatcattctcagcaaactaacacaaggatggaaaaccaagcactgcattttctcacttataggtgggaattgaacaatgaaaacacttggacacagggcagggaacatcatacactggggcctattggggggtggggggctaggggagagataacattaggagaaatacctaatgtaaatgacgagttgatgggtgcagcaaaccaacatagtacatgtatacctatgtgtcaaacctgcacgttgtgcacatgtacccttgaacttaaagtataataataaataaaagatttcattctaagtgcaaataggatgccattagaaaatcgtaagccagagaacaatgtcaccagattgtcttttaaagcagctcatttaagtctagtgcaaggaaaatggattcaagaagctggtggggcagcataggagcaggaaggatggctaggaggctgtttatttccctctactctccatgtcaaagctgatggtggctcagacaaggtggtggaaataaagatggcgagaagtgggtatacattgatatttggaagaaaaattcattgggctagaagtagaggctgagggaaagacaggaatcaaggataactccttgaatttaagtttgagcagctggataatttgtagggttgtttactaagatgcagaagctcaaggagaaattaagagttctgttttgggcgtgttcttctgagatactactgacatcccaggggagggtggtcacataggcagggcagcatgcgactgtgtgttgtggggtggtcagggctgcagatgcaggtctggaagatgttgacacatggggaggtgtttgaacacgtggggcctaaggggcatatctggaaacaggaaggatatggtgctgagtcctgagcttccaccatttagagatcagaggaaggagaaccagcagagaagcttgagaagtaaaggaggaggaaaactaggaaagcaggtggcacatgagtatcacataagccaagacgacaggacatggtgtttcaagaaggaaatagtcagctggagggctgctgatgaaagattaagaagcaaaaacaagtgcccaatgttctttctttgtagattgtgtgagaggcataccatttcaaatcatagaaatgtagaaaactttgtttcttataacaatgtatgaagatttccgtgtcttttacactaggaatataagtagatttagcatttttgcatggtctacagcagagtttttccatggttttgttgtcttatttatataggttttgattggcacagcctgtgcacacagcaggacagtattgtacttatatatttttaaaatgtttatatttctctaatacgtattttaatatagatttttatatgtttttatcctatgtgatgacaaattattcatgaatactataggtatgtagtttatagttgcaaatatctttttgtctttctttctttcttttttttttttttttttgagatggagtttcgctctttgttgcctaggctggagtgcagtggcgtgatcttggctcactgcaacctccgcctcccaggttcaagcaattctcctgtttcagctccgagtagctggaattacaggcgcctgccaccacgcccggctaatttttgtaattttagtagagacggggtttcaccatgttggccaggttggtctcaaactcctgatctcaggtgatctgcccgcctcggcctcccaaagtgttgggatcacaggcgtgagccaccacacccagctgcaaatatcattatttttaacaaaaaaaaacaagtttatgaaacaggaatttgatggaattatcctagaataattttcctatatgtgtatatattttcttaatactagataccctgaaatagttttttgcttaaaattgatctctattaaagaaataccaaaaccaaaaacatcccgcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccgtatgtatggctttatttttctcacaaaatgtggatttcatggatttatcagaaaatacatttacatttgttgaaactctataagcttgtgataaattggaaattataaaaccaaataatatcataataattctgaagggtcaaactttttggttttcatgtcagctcattgcatagcctgattattggtaatattttttttaaaaacattttagtatatgatacttattttataagcttggagaaaatttggtgtttttggaatatttgacagttttagagcagaggtatttgttatagcataccaaacattggatatctttgtcttcagggaatgtaaaaattattaactagttatattccagatagtttgaaggaaaaaatggtacttgtttagttaaggcaaaaagtgctgggaccaagactactgaaaataatgcagagggatgacccatttttttgaagtttgtaaaatactcttatttgagatctatatcagtcagagttttcctgagaaacaaaaccagtaggacagacatgcacacagacacagacacacacacacacacacacacacacacactcacacacacagcagggtggagggagagagagagatttgaaggaacagactcacatgattgtgagggctggcaagtccaaaatccatgaaataggctggcaggaaggaaactcaggaaagagttgaagttgcagttttgtggagcagagcagttcagtaagctaaaaactcaagcaggattcctaagttacagtcttgaggcagaattcctttttctccaggaaacctcagtttttgctcttaaggccttcagttgtttagatgaggcccattcacattcttgagggtgatctcctttacgtacagtcagctgattgtaagtattcatcatatctccaaaataccttcacagtgacatctagatgagcgtttgaccaaacaactgggcactatagtcttggcaagctgatacacaaaattagtcctcacagggcctgtttgcttcactccatgtatatcatagctagtaggaagaatttagctaaaattaactgattaaatgtagtaaatatgagatgaataaagcgaaattcaggcatcaaattactattctcttgggattctacaaatgggagttttctggattcttattcccatcatctttggggaataagaacctacttgttttaggtaacagtcaatgtgataaagaagttttcaaaaattaggtagctaagtagagtatattcaagtgtcatttttatgtttctttcatttcctcagcttctctgtttgttaatatgttggatactataatttcatccctattgttttataaattattttctctgttgtttatattttttagatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtattacttttcatttgatttttcaaagtaccagtttgcctaacaaatgtggttaagagggacagggaaactgcatgttctagttaattaaagtttttgataaactaaagttacgtgagttttcagagaaacagaggctttatttaaacatctttgggctctctcatcagcatcaacctctagctatctctctaaattaaaattggttacagttagttcagaaagattttcctcacacttaatcataaagaaccaaatgattttacattttattgtttgctataatgtgaaggctttcctacttaagcctctcaatgatttgtgtaaattctccagggccttatttctcattagaatttttccatttagcaactgttttttaagaggttgtctttgcatgtatatttagatagaatgtttggggatgcccttgtaagttttcatgatatttgattaacagatcaaggtaatttgtttgcaggaaaaacatattttgtgaaatttctctatacactgacctctctttctgtattggatattaactggtgcttcttcagttgacacttcatagttttgaggccagcaattcttggaaaataatgattgattttttatatctcatagatagtccttttttattaaaaacaaacaaaaattctgatttgaattgtcaaattatctactttttaccttgaaatactgtgtgtggtgtactactaaagttatttgtggaactggaatttttaaggtagcttgcttctctgtgtcccttcaaattgtgctgttattttagaagcaggtaaaataatgagattttgtaatcttatcctgcaaatagcattcaacagcctgagtcaatataccttccaagctaacatatacttagagagtttggctttgaatatagtgatgcacaattatattttttttttgtatattatagagaaaaacataatttaagggaatttggtgcaatatactgaattatataactttgttgagtttttttcttttattttaggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtttgtggcatttcttcagtttcctgatcattccaataaaaccctttcaggagtgcccatgcttacctcataatcagtttgaaatcttattcaggtatttaaatggaaccacaaaaaaatgccctcgaaaatgtttagtaactactggataatacatttgcagattataataagtatattactatttggatggagataatagatttttgtgtagaaagtaacagacacttatttaatacttacaaagttctaggaaatgtttccagtggtgtgcatatacacctgcacacccatggacatgtgtatgcacacgcacacacactgatacttgtcaaaggggagaaatttataggcttctttgtgcttctagcaaagagtagtgcaatgaaatagattacatgaagaggatttgtgaatacagagactggtaactgcttctctttttgaaaagttgaaatgtaggaaattggctatgatattctctaatggtaatgaggagaaatcatagcaggctgctctgccaagatctggggtgggtgatcagaatgcatggatgtcctgtggctcaagcagacagcccagcagtctttctcagtctgaaccacagaaagtgattgagtgactttttttttaattcctcccaaggatggtacatgtcatatcatcctctgtgcatgcattatggcattcattgccactggatgcattatggcattgggattaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataagcaacaagcctattacactaatccatacttacagtgctaccttttgatgtgttgtgtactcgagccttttgtagttgcttaataaagaaaacaaatggggtcttcttagtgagacatgggtttcatagctattcctacattcctgtacaatatgtcctcagttaatgtccacaggttcttggaaactgcagctttaagtgaaatgatgtacaatgtaaccaattttaccgtaagctaattgatataaaaaacaatagttaagttcctacagcatatttctggtcacaaaaacagcgccagacttataataaagatcagctactttgaaattaaacattgaaataaatgtgagctatacctgcatttgagaaagagtaataaaaacaaaataattattcaccctatttttccatttcaaggttgtaggttgccagagccttccatggtagctcagggctcaaggcagggatcaaccctggacaggactccatcccatcgcagggcacagtcacactcacacccacactcactcagactggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaatacaatatgcctaaattgtgtaactcgaaacattttcccatgtattcatagcattacattctgaacatattcaatttataagctgctaaagaacactagggggcaatcctttaacttttccagaaatagctggtatcattttatagtaagttttcatttgacaataaggcaggccaaagagaagattagatattgtattgttttactaagcaacgtgtatagtacaaaattgctctcaggcataagaaacccaaaatatgtgatgtatattacatggactaacacccttgatctgcctagttgttagattgtttttcacggtacctggaacattttgaagcatgtggtagtgcacttttcatttcatttgaaagcttagcattgcatttcataaaaatacttagctttcctaatatgataaatgaattatcatttatgaatttcttaatattgtctttgaacccattttaattatttttatgatttctattttcataaagagtgacaaaagtttactagtttatgcatgcataaaaaccctcttttttggtcactttaatatctctttttaacctatttcaagttgcacagcttccttctctctggcacattccaggattgtggtgtaagactgcacatagatttttaggtgttggtgagttagtcttccaaggaactgtttggggaaaggtgtgacatgcacttaaaccaaagacaagatttttttcaacggtttctttcttccctctcacccggtatataacccattgctctttgaagattgggatattagttacaagagtttacatcctgtcctccctcttctaccttcttggataaaagttgagactttggacaggtaagccacagagaaggaccgcaagggccatgatgtatctaaccctctgtgctgtggcttctaacctgcaagtgggtcttttaacagggtaggtttccattaggctctaagaacaaaagagtcttgatgtaggtttaacaccagaaccttcgagtgtcaactgttagcacctggtaagttgttaacacctggttaacagctggcttttttttatgaggcacagactgacaataagaatcattgacctgctaaagaaacaagcctaggcttgaaatactttttcagaatgcaagaggaattttatatttgtggctgggtcatttattgagcacttattatgtgccaatcactgtgagaagctcagcagatacgaagatgactgagaaataattcctggtgccatgttgctccctgtctagtgtatgaacagccagttataagagcatgtggataaatagtgttggcatgtgcacagggtgttaaggtaccataaatcgtttctgtttgtgcccaatgccatcaagaacaataggcaggaattgctggcaagatggccgaataggacagctctggtctgcagctcccagtgagatcgacgcagaaggcaggtgatttctgcatttccaacttaggtacccggttcatctcactgggactggttggacagtgggtgcagtccatggagggcaagccgaagcagggtagggtgacgcctcacctgggaagcacaaggggttggggaatttttgcccctacccaagggaagccatgagggactgagcctgaagaaccatgcattctggcccagatactgtgctttccccatagtcatcacaacctacacagacaggagactccctctggtgcctacaccaccagggccctgggtttcaagcacaaaactgggcagctgtttgggcagacaccgatctagctgcagaagtttttttttttttttttttttttcccttacctcagtggtgcctggaatgccagcgagacagaaccgttcactcccctggagagggggctgaagccgggaagccaagtggtcttgctcagcaggtcccacccccaaggagcccagcaaactaagatctactggtttgaaattctcgctgccagcacagcagcagtctgagattgacctgggacgctccagcttggttgggggaggagcgtccaccatggctgaggcttgagtaggtggttttaccctcacagtgtaaacaaagccaacagaaagttcgaactgggctgagcccaccacagcgcagcaaggctgctggggtcagactgccagatttctcctctctgggcagggcatctctgaaaaaaaggcagcagccccagtcagggacttatagagaaaacccccatctccctggcacagagcacctgggggaaggggcggctgaaggagcagcttcagcagacttaaacttccctgcctgacggctctgaagagagcagtggatctcccagcacagcgttcaagctctactaagggtcagactgcctcctcaagtggatccctgacccccgtgtatcctgactgggagacacctcccagtacaggctgacagacaactcatacaggagagctctggctggcatctggcaggtgccccgctgggtcgaagcttccagaggaaagaacaggcagcaatctttgctgttctgcagcctctgctggtgatatccaggcaaacagggtctggagtggacctccagcaaactccagcagacctgcagcagagggacctgactgttagaaggaaaactaacagaaaggagcagcacatccactcagagacctcatccaaaggtcaccaacatcaaagaccaaaggtaggtaaatccacaaagagggggagaaaccagagcaaaaatgctgaaaattccaaaaaccagaacgctgcttctcctccaatggatcacaacttcttgctagcaagggaacaaaactggacagagaatgagtttgatgattgacagaagtaagcttcagaaggtggataataataaactcctccgagctaagggagcatattctaacccaatgcaaggaagctaggaaccttgaaaaaaggttagatgaattgctaactagaataaccagtttagagaagaacataaatgacctgatggagctgaaaaacacagcacaagaacttcgtgaagcatacacaaatatcaatagctgaatcagtcaagcagaagaaatgatatgatagattgaagatcagcttaatgaagtaaagcaagaagacgagattagagaaaaaaaaaataaaaaggaatgaacaaagcctccaagaaatatgggactatgtgaaaagactacgtttgattggtgtacctgaaagtgacagggagaatggaaccaagttggaaaacattcttcaggatattatccaggagagcttccccaacctagcaagactggccaacattcaaatccaggaaatacagagtacaccaaaaagataccccttgagaagagcaaccataagacacataattgtcagattcaccaaggttgagataaggaaaaaatgttaagggcagccagagagaaaggttgggttacccacaaagggaagcccatcagacaaacagccgatctctcagcacaaaccctacaagccagaagagagtgggggccaatattcaacattcttaaagaaaagaattttcaacccagaatttcatatccagccaaactaagcttcataagtgaaggagaaataaaatcctttacagacgagcaaatgctgagagattttgtcaccaccaggcctgccttataagagctcctgaaggaagcactaaacatggaaagtaaaaccggtaccagccactgcaaaaacataccaaattataaagaccatcgacactatgaagaagctgcaccaactaatgggcaaaataaccagctggcatcatgatgacatgatcaaattcacacataacaatattaacattaaatgtaaatgggctaaatgtcccaattaaaagacacagactgccaaattggataaagagtcaagacccatcttcaggagacccatctcatgtgcagagacacacataggctcaatataaagggatggaggaatatttaccaagcaaatgaaaagcaaaaaaaaaaaaaaaaaaaaaaaagcaggagttgcaatcctaatctctgatgaaacagactttaaaccaacaaagatcaaaagagacaaagaaggccagtacataatggtaaagggatcaatgcatcaagaagagctaactatcttaaatatatatgcactcaatacaggagcacccagattcaaaaagcaagttcttagagacctacaaagagacttagactcccacacaataataatgagagactttaacaccccactgtcaatattagacagatcaatgagacagaaaattaacaagggtattcaggacttgaactcagctctggaccaagtggacctaagagacatctacaggtatctccaccccaaatcaacggaatatatcttcttctcagcacctcgtcgcacttattctaaaattgaccacataattggaagtaaaacacacctcagcaaatgtgaaagaatggaaataataacagtctttcagagcacagtgcaatcaaattagaactcaggattgggaaactcactcaaaactgggtaaataacaaaatgaaggcagaaataaagatattctttgaaaccaatgagaacaaagacacaatgtaccagaatctctgggacacagctaacacagtgtttagagggaaatttatagcattaaatgcccacaagagaaagcaggaaagatctaaaatcgacaccctaacatcaaaattaaaagaactagagtagcaagagcaaattcaaaagctagcagaagacaagaaatagctaagatcagagcagaactgaaggagatagagatatgaaaaatgcttcaaaaaatcaatcaatccagtagctgattttttgaaaagatcaataaaatagattgactgctagccagactaatgaagaagaaaagagagaagaatcaaatagacacaataaaaaatgatataggggatatcaccactgatcccacagaaatacaaactaccatcagagaatactataaacacctctatgcaaataaactagaaaatctagaagaaatggataaattcatggacacatacaccctcccaagactacaccaggaagaagtcgaatccctgaatagaccaaataacaagttctggaattgaggtagtaattaatagcctaccaaccaaaaaaagtccaggccaagacggatacaccgccgaattctaccagaggtacaaagaggagctggtaccctaccttctgaaatgattccaaacaaaagaaaaagagggaatcctccttgactcatttcatgaggccagcataattctgataccaaaacctgacagagacacaacaaaaaaagaaaatttcaggccaatatctgtgatgaacatcgatgagaaaattgtcaataaaatactggcaaaccaaatccagcagcacatcaaaaagcttatctaccatgatcaactcggcttcatacctgggatgcaaggctggttcaacatatgcaaatcattaaaagtaatccatcacagaaacagaagcaatgacaaaaaccacatgattatctcaatagatgcagaaaaggcctttgacaaaattcagcagcccttcatgctaaaaactctcaataaactaggtattgatggaatgtatctcaaaataataagagctatttatgacaaacccacaaccaatatcatactgaatgggcaataactagaagcattccctttgaaaactggcacaagacaaggatgccctctgtcgccacccctatttaacatagtattggaagttctggccagggcaatcagacaaaagaaaggagtaaaggatattcaaatagaaaaggaggaagtcaaattatctctgtttgcagatgacatgattgtatatttagaaaaccccatcatctcagccccagatatccttaagctgataagcaacttcagcaaagtctcaggatacaaaatcaatgtacaaaaatcacaagtattcttatacaccaataacaaacaaacagagagccagatcacgagtgaactcccattcccaattgctactaagagaataaaatacctaggaatcaaatttacaagggatgtgaaggaccttttcaaggacaaccacaaaccactgctcaagggaataagagaggacacaaacaaatgggaaaacatttccatgctcatggataggaagaattaatatcgttaaaatggccatactgcccaaagtaatttatagattcagtgctatccccatcaagctaccattgactttcttcatagaattggaaaaaactaccttaaacttcatatggaaccaaaaaagagcccgcattgccaagacaatcctaagcagaaagaacaaagctggaggcatcacactacctgacttcaaactacactacaagcctacagtaatcaaaacagcatggtagtggtaccaaaacagatatatagaccaatggaacagaacagaggcctcagaaatacaccacacatctacaaccatctgatctttgacaaacctgacaaaaacaagcaatggggaaaggattccctatttaatcaatgctgttgggaaaactggctagccatatgcagaaaactgaaactggaccccttccttataccttatacaaaaattaactcaagatggattaaagacttaaaagtaagacccaaaaccataaaaatcctagaagaaaacctaggaaataccatttaggacataggtatgggcaaagacttcatgtctgaaacaccaaaagcaatggcaacggaagccaaaattgaccaatgggatctaattaaactaaagagcttctgcacagcaaaagaaactatcatcagagtgaacaggcaacctacagaatgggagaaaatttttgcaatctatccatctgacaaagggctaatatccagaatctacaaagaacttaaacaaatttacaagaaaaaaaacaagcccatcaagaaatgggcaaaggatatgaacagacacttctcagaagaacacatttatgcagccaacaaacatgaaaaaatgctcatcatcactggtcattagagaaatgcaaatcagaaccacaatgagatactatctcacaccagttagaatggcgatcattaaaaagtcagaaaacaacagatgctggagaggatgtggagaaataggaatgcttttacactgttggtgggagtgtacattagttcaaccattgtggaagacagtgtgacgattcctcaaggatctaggactagaaataccatttgacccagcaatcccattattgggcatataccgaaaggattataaatcattctactgtaaatacacatgcacacatatgtttattgtggaactattcacaatagcaaaggcttggcaccaacccaaatgtccatcagtgatagactagataaagaaaatgtgacacatacaccatggaatgctatacagccataaaaatggatgagttcatgtcctttgcagggtcatggatgaagctggaaactgtcattctcagcaaactaacacaagaacagaaaaccaggcaccacgtgttctcactcataagtggtagttgaacaatgagaactcatggacacagggaggggaacatcacacacttggggcctgtcggggtgggcactaggggaggggtagcattaggagaaatacctaatataggtgacgggttgatgggtgcagcaaaccaccatggcatatgtatacctatgtaacaaaactgcatattctgcacatgcaccctagaacttaaaatataataataataaaaataaagaacgaatgataggcagtatagaaaatggtattggtgatgcagtcttggattacggaaatggaagagcgtattgagaacatgatcaactcctaaaaactttcaaattcatttttaaattaatctaacctcttttcttctgtaggtgaaccagcttttcctcaaatctgctctaactcatgttccattttagcatttaattaccgctccctggggatctgccacatcatacaaatctgtgtgtaccggatgggcctgtgagcagaggagctaggcgggaaggcacaagtgacctggtgctttaagctgacacctggctattcactcttaggaaaataaagataaagaaaaatcattagctgcccagccagtgactttcatggggggaggggtacactcttacaggagaggtgcgatatacatgattaaaatttttctgtgatttatttgttttttttttttagcacttgacccatgattcatgttcagtgaatgtcattttgaatgaataaaacacctgttaccctcatgttgcccaatatttgaaaccatcatggtatatattttgcaaatttgaggatgtgttgtctaaattcattatatttaaaagaagaagagactttacagaaatggttgatttttacattcaatcaagatatgcaaagtttttgggaatattccaggttgtgagataacttgggggttattaccaagaccaacgtttctatgggaaaatgtgctgtaagtttcaaaaataactttttgcataacatcaatacataaattccagattccccctattttgttggattctaaaattttgaaaatatgtaacacataggattaatttttatttatccaacataaatcagtacactgaaattattcattttgagtaaatatgatgaattattagtattcaatgaggaggaggaaattattcaatgaggaggaggaaagtgagttttgccaagtttataggagctgacactttgccagagtgccccttccgttttcttgatacttgatcctatcatgaacactgcctgtgtggctactgtcattggtgaagccatttgggcacatgtgaaaaatttgaaaatttgtgttttttttgtttagttttgtttgttcttttttgggggagaaggggagacggagtcttgcactgttgccaggctggagtgcagtggcacaatctcagctcactgcaacctctgcctcctgggttcaaatgattctcctgcctcagcctcccaagtagctgggaccacaggtttgcaccaccaagcccagctaatttttatttttattttttattttttattagtagagacagggtttcaccatgttggccacgctggtcttgaactcttggcctcaagtgatccacccgcctgggcctcccaaagtgctgggattacaggtgtgggccactgtgcccagccaatttgtagttttttatactctacatcttccactccttatctcacaccctacatactggtggtttgttttgtgatggggaaaagtgcatgtattgatgaaactgtttgctactaaagcaacctcaggcattatgctaatggctcaagtcaaagaacagcatttttctctgaaaattatttctaaatcactgacactgtttgtttataggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtaattggccctgtgtgtggttctctcagcagaacactagagggcagcttttacaggaaggacggagactcttagagctagaatttctcatgagtaactattttcttaaatataaataactctgtgaatatcaaagtagatgtaacagatatattatataaaataattagtctattttcaacattcagtaggaaaaaaagagatatgtccatatctcttcttgatattttgtatctaatattgaggtattttatgttaaataattaaaattataatgaagcactaatattccacactttttcgcatactaacattgtgaatgtttatgtttaatattcagactttggtttacaggggcgagtttgtcttgatgtagataaatgctgatggtcagatcctgtgatatggttgcaactaagtatttgcatcttctgtctgaggtcgttgtaggaaagattatttcccaatcatttcataaatgcacatgagaacaaagaacaacttgagggctttcctttcctttcaggcggattctgtcaatatatgaaaaagacaaggctgttatctgtggctatggtaacgtgtgtatgtttgaagccattgtgtgatataattctatcctactccttcaggtgggagctgaagtgactcgggcaagcctggctcaagatgctgaggtggaatctgtacagatgaatgggcaggaatatgggcagatatagtctctggccactaagggatgctcttcagctactcccgcctgagcatcttctccaaggagaatgaatgtgctttttctcttaaaatagaatacactggctattaaaataactgagagtaaaaggttttttttttctttacctcctcttctttaagagtgaatgaggaaatagaattgattaatgctttgaattttgttgtcttctttttgttcatgtgttgttataaaaaaaaaagattcagcaaaaccattcatttggaggaaaacatttcctactccttatccatgcacattgtcacaatactgtatcaccccaaagggcaaggttagagtccatcatggtacattcacatctttggtgtaacctctatacttgtatcagtgtttggtgtgtgtgtgcacgcatgtgtgtgtgtatgtgtgatgtggctagggcatttcaaaatagccctctagtcatgtagcaagaatgatctcactcaaagcttttggcagttgctaagcagaagcctcactgggctgggcatggtggctcatgcttttaatcccagcaatttgggaggcccaggtgggtgaatcccctgaggtcaggagtttgagactagcctggccaacgtgataaaaccttgtgtctactaaaaatagaaaattagctgcatgtggtggcatatgcctgcagtcccagctattggggaaggtgaggcatgagaatcacttgaacctgggaggcagaggttggagtgaaccgagatcgtaccattgcactccagcctggatgacagagcgacgctctgtctcaagaaaaaaaaaagaagaaaaagagaagcctcactgtaacagagaatctaggctggggtcaaattaaagtagttgttgtttcttttcctctgtggctccagaagttatcctgcggaaccctctcatgtttttctgttattcttcattccaatttaagaaggggagaatgagttttaatatataactcttgattaaatggtatcccaaatttatagctattgagaccaaaagaggtaaactgaattgttcaaatcaaaatgtgaagccaggaatctgcttttattcttactcattgctcagaacttatttcatctataaatcacataccctgggaacgttgcacataaaacaaaatcttacttgatgcttgtgataaagatgggtattaaaaaaaaactttgaagttttctggtcttcaaaaaaagatataaaattaagtcagagctgaaaagaaccctaatagaaggtctagttcatggtgcttactttataaatgaaaaaatacactattatatcttagaagtcaaattttagttctacaaatgaggttctggaaagacccatgaacaagtcatattaaatgccatttaacatattttgctttcatttaaccataattatgcttatctttttttggatgttgttcattcaaaagataacgttttgattaaaaaaagaaaaagctatcaactataacctaaataataaagtaaaataaattttaaagtctgagatgttatttcttaagcacttctctttaattcagtatgagacaaggatatatattgtataaaccaagggaaagtttacgtttaacccattcctcagaaaacaggaaggtttagagagaaataaaatactctaagcatgattttccctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactgggtgagttgtagtttttctaagatgagtcctgtagaatattggaaggatatcactggccactaattgtcttgggttatccttattctggacactaaatgtagttttcgaatacaatgctcccatatttaagtgatcagagtagtgcaggctgcttggtgagaaaaggagagaagcttttttcagtcaaattaacaactccatgccttacctcaaaagactggggtcactaagcaaactactctgtccatacaataggagtttgttgaaagtagttctaagaatctaatttggcaaatacagtaataagaaaaataaaaatacatacagctcttgtatgcatttccatgttcacctgactatttctggcagtagggcagctgttactttagatactttattttttaaagtataccattaggtctttgagagctagtgagatgcaaatgttagatggtttgacctctaccgtgttatagcaagctcattgcaaatttagataatgagagtttataaagaaccctccagtgggctctgaatctgaggatctccctccttgattcacagggtcttgttggtcaccagccaaacgccatttacactcagtaagaaacctaatgaatcctgcagaggactgagatcctcagtctctcagaaaggagggaatgattttcattttcccaagatctcggcatcactgagagataagaaggaatgaaagctaaggtcctatagaagatgggggatgagggctaggccagtgaaaatgacaacattttcatgccagcttccatcctaacaggaatcccagaaaacagaaagagagaaattagctgcgtgattgagagacaccatagtgtgataactgccttggatactggggtttctttagccactgcataggtgcccctgatgtgatgtctcagacattgtctcctcttgttttccttttggcatgtcccctaagttaaagatatttaattattttttcctgtttattttctagccctttttttcctgcagaaactcttgtcttttacttccttacccctctgtcactttgggtgatatgcatagcttcatataatctagggtgtttgcaaaaattttttatgttagtaaccacttgctacatatgaaaagacttatgtgtagaaatattgcttattatgagtgtatatgcggctttgtgcttacatatcacattagtcttcaaacgcttttgtgagtttatgttaacttgattcagctaaaataacaggagttcccaaataatagatctgtatcttcaaacaggttcatttagttttttgagcctttgtaataaattttcaaacacaatggaaagtacagtgaacacccataaactcactgactagatttatttatttattttatttttaatttttttttttgagacagagtcttgctctgtcacccatgctggaatgcagtggcgccatctcaactcactgcaacctccacctcccgggctcaaggtattctcctgcctcagcctcctgagtagctgggattataggctcgcaccaccatgcctggctaatttttgtattttttgtacagatggggtttcaccatgttggccaggctggtctcaaactcctgacctcagaatccgccctcgtcggcctcccaaagtgttgggattacaggcgtgagccactgtgcctggccttgactagatttaatagttgttacagtctgctatatttgtgacattttttctgaagcattttaaagtaaaatacatagattatgatatttcaccccaatctacttcaatatgtatcctaaaaatatgctggggccagaatttaaaccaaagcctgacactaagtctatattaaagcttgcctaacaccagtatcttttcactactggattttgtcattgagccaggaaagaaaaagatataaaggagaaaagtaaacagggaccgaaagcaagatttgtgtggtctcctgtaagtttacctctcccccgacccctttttaaaaatgttttaccttttgtgaactataattgaattttggaaaagaaaatacactactacagttttaaaagtcaaatcccaatttaagaaaagaaataataccctactttgctttttcatgttttctttcagggagcctttcattttcccacggtgaacaaaggaaaggagttttcctgtggacgtttcctagccctggttggccagaggcctttgttcttcacctatcaggagtgcagagcagtgctcctggcggagctcaactccggtaagaccaacctcattctcacccaagaaattctctgaggaataatctggaattcatccatcaaaacagaaaaaggcacaagggttattctccttgaagcaaacacaaacatagttttagtgtagagcatcacgtggcgtgcatgctggagagggaggtggctcttaggagccccaccacccactgtttgctctaaagagagctcctcatgccccaccttgagaatggggtctggggtaccatctccactaagagccatgatggcagttctcctcttgttaaagacagctatcttctgagaagctgaaaatacctgattgccccaagtgattaagagtaagaataagattaagtaagaataagacatcacagtagggtgataatattacttatttggaccagtggccctttgactttaatttaattttattgaattttactatgtatctataatgactgtttctgcaaatacagtatatttgcagataaatacgtaccagccaaaagcaatttactttccttatttctgggatagactcgaccagagcagcagagggcagacctgctattcagacttagggatttagtcctggctctgccacttactcgctgtgtaactttgagaaaattacttgatctttctgttcttcagtttacttgtaaaataaagaaaattttggggtatgaaaactagagtgtattcaagtatgtttgtgtacatgtttatgtgtgggggatctccattggggaaataaaatatgactttagattatacatatgccatttttaaaatgttcatccagagaacatattttagggttacaaattcaaatgctttaacagcaacaatagttattaacagtattatagtgcttggccaggcgtggcggctcacgcctgtaatcccaacactttgggaggccacagcaggcagatcacctgaggttaggaactcaagacaagactggccaacatggcaaaaccccatctctacttagaatacaaaacatcagccaagtgtgatggtgcgtgcctgtagtcccagctacttgggaggctgaggcaggagaatcgcttgagcccaggaggcagaggttgcaatgaactgagatcgcgccacagtgctccagcctgggcaacagagtgagtgagactccgtatcaaaaacaacaagaagtagtattatagggcttaccctaggccaggcataaatgtttttttttttttgagatggagactcgctctttcgcccaggccggactgtagtggtgctagctcggctcactgcaagctccgcctcccgggttcacgccattctcctgcctcagcctcccgagtagctgggagtagttgggacgacaggcacctgccaccgtgccctactaattttttgtatttttagtagagatggggtttcactgtgttagccaggatggtctcgatctcctgacctcgtgatccgcccacctcggcctcccaaagtgctgggattacaggcgtgagccaccgcggccaggcataaatcttacagtgcttactctaggccgggcataaatacacacacacacacacacacacacacacacacacgctctgtctctctttactctccccagcaaccttacaaagtagattatattatttgtctcattttatagatgacgaaagtcatagatagattatgcgataaacccagaagcacacagttaatatatgttggggccatgatttcaacccaggctgaatggcctctgtgtgaggtattaaccactgttttatgtactgagtgctggctgcttgacaagagagagtaatgggacctgaagaatcctccctaaaggcatttaaatttatattaaaaccaaaaacttgttagcaaaagaaaataaacctgtagacagaattaggccgagagaccagcagttgtaacctctgatatagctattaactcacaacaaaaatctataggaaaaaaactaagaataaatgattctatcatgggtgtctgtcctcattcatacataaagttttagccacatttgcatgagaggttagttccattactggcagctgaagaaagcaaggattttactgctagtgccagtaactatttctatttggtagataacaaagctggcagaggtccagaacattgtagtaatattgttccccttgtactgatcctaagagagagcctgattttcacatccctcagacagctgctctgggatgatggagaaatagaccagagacctataagcttttcatttagctcagacttgttagttcctgtccctgcttttgcagctcctgttcttacatttcttttgcccttacatatcaataaatagggtttgatggaatttgaaatggcacgtcattgttaagttgctgccctcatgagcagcattttaaatatgtgaatgatgaatctctacagtcatattcctattttttaaaaaatcaatttcttcatgatttaatttttttcccagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacaggtatatctttgaaatgatggagataaaaatatacttttatggtacataatttgtattaaggtgaatctagcttaaatttaatggaagaaggtgaagttcttaagttattcataggaatgcattaaagtgttgtttttctgtagcatggacccatgacatgaactcatgatgtgctgttctgagggccctataatttaatgtactataaatgtcactgagatcagagccagtaatacaatctataaatctatactctcacaatataaataacgtttaatttaatcatccaaacacatgattgcctatcctgttttgaaacttgattctaaatttaccagctactttcagtaatccatcctaaagtcaaagatctcattggcaggaaattcttttttttttttttctgttaccaaaaagatttaaactgttgccttttgttttgcttttgacccaatgtagttgatatagccatcatactattgtgtatatacgttacaatagcttaaaattttaataatttttttgtttctcatgtatcttatgcaatcttttcatgacagtttgcagtttacctctgaaatcatactgtatttttttttttttttttggagatggagtcttgctctgttgcccaggctgtagtgcagtggcatgatcacagctcactgcaacctctgcctcccgggttcaagcagttctctgactcagcttcccgagtagctgggattacaggcacctgccaccacgcccggctaattttttttatttttagtagagacagggtttcatcatgttggccagctggtcttgaactcctgacctcgtgatccacctgcctcagcctcccaaagtgctgggattacaggcgtgagccactgcacccggcctgaaatcatactgtatttctttaaatgaaatacatcagcatgtcaataccttataggaattagagaagtgacaggctatctcatgattcttttcttttttcattttcatgttttattgtaaagtgacaacttataattgtacatatttagagggtacaaggaatgatgttatgattataaatgcagtgtagaataatttaatcaagctagttaacatgtacattacctcaagtacttaactttttttatagtgagaatatttcaaatttactatcttagaaacttggaaatgtacagtactctatattaaccatattcaccattctgtgcaatagacctcaaaacatatttttgagatttgatgcttcctagagttcgtattttattttagccactcagttttaattcagtcataattttgcaatcttttaacttcctttcatatgctcagcattatctcatttatgttaacctacaaatttacatcaattagtatgatttattcctgtttctacagtttatgaagtgtgttgtaaattcttattctattctacaagttatttactgattttgattcaaattggcttaatgccatttatatatttctattaaaattaatttggtagctgggcacggtggctcacacctgtaatcccagcactttgggaggccgagtcgggcggatcacgaggtcaggagatcgagaccatcctgactaacacggtgaaaccccatctctactaaaaaaatacaaaaaatttgccaggcatggtggcaggcacctgtcgtcccagctactcgggaggctgaggcaggagaatggcgtgaacctgggagacggagcttgcagtgagcccagatcacgccactacactccagcctgggcgacagagtaagactccgtctcaaaaaaaaaaaaaaaaaaaaaaaaaaaaaaaatttatttggcagtcagcatcctccttctcattctaatagagacacagatattttattacaggtatttgaatataaccagggctgatagtaaaaatacttaacaattagtttggcactggccaggcccattaaaatggcttctggaggttctttgctgttccaagccatactccattaattactggatcatggggaggtcttgttgtcctggttagggaagtggcagaggactctttaggggctcaggatagaagttaggtaccaactggaatggaagtgcttccctgttttatcagacaatatagcctaccagtgcctaccccttcatcagctctgagcttagttttaactcaacaggcaaatggtaactcagctgagctctgtgagattctgtaatgtttaccttccctacataaggcacactcatcacacacctgttgcaaatgaccgataccctaccatagctaccactaatgtcgtatgatgtaattggcctgactacaccaccaggcacattcacgtggtcataataccttaagttcctttacctgcaaatgttgccctcatcttttccctacctgacatttttttcttaataatatttctcacttaaccggataattaattttgctgcatccacctacctttataatcttttcacatttagattttagaacaaactttctgagtaagtcagggaaaaaatagtttatttagttttgattttgatcattggcacattacaagtctggaatcattttactagaaatttgaaatcaaatttattattgtaaatgtgacaagggaagtgttttttcattagaatcatgctagttgctattgccttggaaaaggaaatgagggttctgctgtgatagtcttgtaatctacttgaagagcccaaatcctcacttaaggtgacaagaaaagaattgctgccaaagataaaaagtcaatgtcagattctgataccaggctacgaagtgattgcagtgattaattggtgaggatgagaattggcagtctgaaacaaaacacacatgagaccctaggacaaatgtagcccatcacttgcatgtccctaataaaggggctccacatttactttaagaccagggaaatggtccaggggctgatgactactagttcttccctatcaggacagttcagtggttttctgtttccttaacccaacctactccctaatttcagaagttctgtctccttagaatgccaggaatcaggtttcagggtgatgggtacacatgataatatggtttggctctgtgtccccactcaattttcatctccagttgtaatcccccaaatccccatgtgtcaagggtgggatctggtgggagattattggatcatgggggcagtttcccccatgctgttcttgtgatagtgagtgagttctcgtgagatctgatggtttaaaagtagcacttcctttgctgtctctctcctgccaccatatatgacgtgctttgcttccccttccaccgtgattgtaagtttgctgaggcctccccagacatgcaaaactgtgaatcaattaaacctcttttgtttataaattacctaatctcaggtagcatctttatagcagcataaaaatgaactaatacacatggttttcgaggccaattgctttaggatcattgcttctaggaccaatgcaaaacagggccatggagaatagaaagcagtcagaactatgcagtggtatttctctagtctgagaagctggcttagttgctgcctagggtttgaagtgatgatttctgtatagtatgaaccctagttttgttccagtttaaacatttttttttttagtataatggtacccgtaacctcaagtgttgcttaggaaagtttctgataccgagatgctcaggagttccttaatatttctgttttgttctggggcaaatagcttcatggatagcatagagggtcttttaatcaaacgtcttatgtgaaggtaaatccgttgaacagagttcatttatttgacaagtatttattcaacacttactatatgctcagttctgttctcggagctggggatacagtagcgaataaaagttgatgctctagtagggcttacattctgtgagggatatatagccttaaaacagataaatatctaaaatttcaaggactgtcaaatgtaaagtaggatcttaatagaaaaatgaatatgtgtgtgtcagggggaaagagtgggatttgatgttttatttcttcttttcttctattcccagttagacaccttgatgttatcacagtttagtttatttttaataaagatcttttaacaactgtagctctcctcaccacctgtgaatttctcacttttaaaccatctgagctggcaagattagtggagcatgggaggtcttttaaataattcttgaatatattatagccctccattctttttttcagggagtgaccttcacaatggcatcataggattcagtgaggagtcccagagtggactagaactcagggaaggagctgttatgagaagattgcaccttattgtcacaagacagccaaacaggtatgtgtatatatagtatatggaagacgtaacattctgtgtgtctgtacaaatgtaatttcaattcatacaatggtggagggcagggtaagatagaaggaggtagtgtcgaatttggcacgtcttcagatgctctagttcttaatttgtgattatggtacttcgtttatgatcataacttagggttaccttgagtgttttctacttcatgaagtaccatacaaatatcagactatgtaggtcatcacttcatcatattgcctattatctgctcactctacatacataccattttcctgtgatgaaaacttggagtaccaaaactttgtttgcaacttaaaactgtatagtagcatctttagatgctcatcacatacacgtgcttggtatgcacacatgcacatgtgtatatattacattttccattttgggcctaaataatctgtgagaatgttggtctccctttgccctattttacaatagcaaccattatgagtggaagtgttgtttctttagaaaaatcctttttaaaagagaaatgaggaacatttacttgcctttaggacctccctataattctcattttcacattttttggacataatagaaaaatatatttttttaattttctgtttttttttaaattttattattattataatttaagattttttaaattttattattattatactttaagttttagggtacatgtgcataatgtgcaggtttgttacgtatgtacacatgtgccatgttggtgtgctgcacccattaactcatcatttagcattaggtatatctcctaatgctatccttcccccctccccccaccccacaacagtccccagtgggtgatgttccccttcctgtgtccatgtgttctcattgttcagttcccacctatgaatgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatctatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacaccctttccagcacctgttgtttcctgacttattaatgattgccgttctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattgtctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctgtgtcctgaatggtaatgcctaggttttcttctagggtttttatggttttaggtctaatgtttaagtctttaatccatcttgaattgatttttgtgtaaggtgtaaggaagggatccagtttcagctttctacatatggctagccagttttcccagcaccatttgttaaatagggaatcctttccccattgcttgtttttctcaggtttgtcaaagatcagatagttgtagatatgcggcgttacttctgagggctctgttctgttccattaatctatatctctgttttggtaccagtaccatgctgttttggttactgtagccttgtagtatagtttgaaatcaggtagtgtgatgcctccagctttgttcttttggcttaggattgccttggcgatgcaggctcttttttggttccatacaaactttaaagtagttttttccaattctgtgaagaaagtcattggtagcttgatggggatggcattgaatctgtaaattaccttgggcactatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgatttttgtacattgattttgtatcctgagactttgctgaagttgcttaccagcttaaggagattttgggctgagacaatggggttttctagatatacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaaatcggctgtgaatccatctggtcctggactctttttggttggtaaactattgattattgctacaatttcagctcctgttattggtctattcagagattcaacttctttgtggtttagtcttgggagagtgtatgtgtcaaggaatttatccatttcttctagatattctagtttatttgcgtagaggtgtttgtagtattctctgatggtagtttgtatttctgtgggattggtggtgatatcccctttatcattttttattccgtctatttgattcttctctctttttttctttattagtcttgctagcggtctatctattttgttgatcctttcaaaaaaccagctcctggattcattaattttttgaagagttttttgtgtctctatttccttcagttctgctctgattttagttatttcttgccttctgctcgcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttccagtttgattgcactgtggtctgagagatagtttgttataatctctgttcttttacatttgctgaggagagctttacttccaagtacgtggtcatttttggaataggtgtggtgtggtgctgaaaaaaatgtatattctgttgatttggggtggagagttctgtagatgtctgttaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttttgaatctgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttaggggtgattttgctcattagttgatgcagtttcttcttagtctcgatggtctttacattttggcatgattttgcagcggctggtaccggttgttcctttccatgtttagtgcttgcttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctatgagggtaacccgacctttctctctggctgcccttaacattttttccttcatttcaactttggtgaatctgacagttatgtgtcttggagttgctcttctcgaggagtatctttgtggcgttctctgcatttcctgaatctgaatgttggcctgccttgctagattggggaagttctcctggataatatcctgcagagtgttttccaccttggttccattctccccatcactttcaggtacaccaatcagacgtagatttggtcttttcacatagtcgcatatttcttggaggctttgctcatttctttctattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttgtacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatgatgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgcttcggggtcaggggtcaggcacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcctggctgctttgtttaaataagcaagcctgggcaatggcgggcgcccctcccccagcctcgctgccgccttgcaggttgatctcagactgctgtgctagtaatcagcgagactctgtgggcgtaggaccctccgagccaggtgcgggatataatctcgtggtgtgccgttttttaagccggtccgaaaagcgcaatatttgggtgggagtgacccgattttccaggtgcgtccgtcacccctttctttgactcggaaaggaaactccctgaccccttgcgcttcccaagtgaggcaatgcctcgccctggttcggctcgcgcacggtgcacacacccactgacctgcgcccactgtctggcactccctagtgagatgaacctggtacctcagatggaaatgcagaaatcacccgtcttctgcgttgctcacgctgggagctgtagaccggagctgttcctattcggccatcttggctcctccttcatgtggcgttatttctgagggctctgttctgttccattgatctgtatctctgttttggtaccagtaccatgctgttttggttactgtagccttgtagtatagtttgaggtcaggtagcgtgatgcctccagctttgttcttttggcttaggactgactcggcgatgcgggctcttttttggttccatatgaactttaaagtagttttttccaattctgtgaagaaagtcattggtagcttgatggggttggcattgaatctataaattaccttaagcagtatggccattttcatgatattgattcttcctacccataagcatggaatgttcttccacttgtttgtatcctcttttatttcattgagcagtggtttatagttctccttgaagaggtccttcacatcccttgtaagttggattcctaggtattttattctctttgaagcaattgtgaatgggagttcactcatgatttggctctctgtttgtctgttattggtgtataagggtgcttgtgatttctgtacattgattttgtatcctgagactttgctgaagttgcttatcagcttaaggagattctgggctgagatgatggggttttctaaatatacaatcatgtcatctgcaaacagggacaatttgacttcctcttttcctaattggatgccctttatttccttctcgaaaaatattatttgtttttacattccttatacagagtattaggatacttattcattgttgaatggagtgtattcaaagaaaaccacataagccctgaggcttaatcctcttatctgtagtgaggaaaattggtcattttctgcatcatcagtggtaaagtaagtgctatactttggatgaagaggtaccatttggtatactttggatgaagaggtaccattatttgataataaactctattagacatggggatgacaccctctgttaaggcattggtgggtttcttgctcacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaagaaatgaagagacacactagtgtcaacttctaattatatttctttagaattaatcattttaaaaccactattgaaacttacacattgttgatagggagattctttgtgtttttcttagccataatgtctaaatctctttgccgacaacaggctttagacagacttgattacattatggtattttgtaaataaacttgtcatttttctatttttttgtttcttgccattctaaaataacaaccatgtaggtttaacttcttttatttgtattcttggtacaattctttccttttctagaaataaatgtcttattcacaattctttttgttagccccttcctacttacatacaaagaaaaaaatgtttatcattgcttaataaatgaacacatgcttaataaaagacatgtcgatatgctaactcttctacacattaaaattaataaaatattaagtatatgctgttagaatcacatttatcttgcatggtatctcttttttatattacaataacatttctttcagtatcactataaattcaaattcaaataatttttattacttactaagtgattttctttttggtattcaaatagtcatggcatggccactggtagtcttattaagctggtcttttgtcttttcaatattacttttaaaatatctggaagcatacttgctttatagcaataacaaatattctagagctgtcttgattttttccctgatgtaagacagccaattaactagtgtcaaaggacttgatttctttgatcagaaaggattttagagatctatatgtatgtactacagctatataggaaagttgatgcaggcaaatgtgttgctgttgtggccaccttggtggtggtagtgctggaaaatatattttccttaaagcctggaatccccactctttttcgtagtttagcatatcacatcattgttttttgcttttcttgagtggagttatcatcagctactaaaactttctgtcacactgacaatgaggaactgaaatttcaatactcaagacatttgatcatatagtatgtcctcacttcacgtcctcaataggctcttggaaactgcaactttacgtgaaacaatgtgctgtataatgaaaccaattttaccatagactaattgatgtttatatcagttaaacagttgacttcctactgcacacagtatgtcctttcatttaaagttgctgtttccaagaacctgtcatggttaagtgaagacttactgtattctacttgaatttaaactcttcttcatgcatttcttccaaatatttttatgcttccatcaaccctctcaaccccatatttcttttttttttcttttttgaggtggagtctcactctgttgtccaggctgcagtgcagtgctgtgatctcggctcactgcaacttccacctcctgagttcaagcgattctcatgcctcagcctcctgagtagctgggattataggtgcacaccaccatgcccaactaatttttgtatttttagtagagacggggtttcaccctgttggcctggctagtctggaacttatagcctcaagcgatccgcccaccttggcctcccaatgtgctgggattacaggcatgagtcagcatgcctagcccccatatttcttaactatagctttccgttaatcaaaataccactttctccatgatgcctcccatgaaacctctagttggagtcgttgattctctaaatttataaaacattatctgttcctttcctatggaaattatcagttatatgcagtgttacaacttatgcatagtttatatagactataagactgttagctgttcaaaaattagaatatggttttgcattcttcataaatatgttttgcatacatgattactaaatattatattgtgcattttatctcaaataggatttttggtgaattagaatactgatacgatctcactaggctttaaacatctgtctcgtacagtagatgttaaacttgtaattctaagaagagagaggagaagagccattaggagtgggcttgggcaagctgaataaagagaaataggaaagttaaagtataggtggggttagggtagactacttcctctgagcttgccctccttgcagaagaatatataattaaggggtaagaaaatgttgtatgcaatacatgggatgctaactgtatatatttgttttcctaactagagaaatgctactgagcccattatcaaaagtttcagttaggtaagagaaaaaaattagtcacacctcttctttctctttcacatatgatattcaaatcgtagagttttcttctgcattctgagaagcagctaattttcaagacattttttccctcattatcttttcacctgttaaaaggcaaggaacaagcaaggttaatatatattctagtttcattaagaggaaatttaaaaagagagaagatggaagatgattattttctcatgaaaatgaaaaagtgtttttcaaaaagtactatgaacttttgatatacattttaacattttacatgttattagtagaagggaatttattactcatccagttcaaattattattatgtcagataaactgagacctaatgatatacacaatacatgttctgtgacaatattcttctgtagtgggctttgagaaattatttggaggtcctagtagagccacccaattattgctagatttttgacctaagcaccatcttcttcattttttgtcaaaggaaagacatcagttacactgaacttattcttggagtcactggagtcagtttaagagttagggttctgataatggaagactttagttcaaatattaactcttctaccaattagctgggtgacattggacaggttgcttagccttcctgagcctcccaggtttaacggggttaataacagggctgtgaggcagataaagaaaataatgaatgagaagttcttagcacagctctcggcagagttggcccttcataagagatggtgagtattgagattattcagaatggatggagatggagcccgagggaatgcaatgacttgagtaataactacatcaacacaagtggtagaagagttacagatattgcagacacaacaaatgcatccacagaattacaccactcattaatggcagtgtccctcacctcaatccagtctattggcactcaaagttttttgactctgtcctatctcagattatcatctctacagtttttcaatactttcacttttgaattatgaagaatttaagtaactcgcccaattcaattactgggccaagattagaactcatctcttgaattccagtccatttccccttttcctgattatttatcttatgattctatattagtaaaatgtaaaaggtaacaacttaggaagcatgctcttaaccacaaaatctgtttgaatccagtgtttaaatatttgttgcaaatattttcaaaaatatttaagtaaggtattgtttcattgttactttggtttttctattgctgaatagttctggtccctggaaaaatcatcttatactagttagggcaaaagatcatcctgggatgcttctgacctaaccaggaaaagaacctgctgggaattacacatggaatgggctcttatgaggtctctgtcatttttaggagtctagggaggttcacatatgatctgcaagtcttgatttctcattagacttcagaaatattgtttcaatagagtgtttatttctaagacttgaagactctttatgttactagtctaatgatatgtaggcacccatctttacactgttcaatttcagatgattcttaacttagattataacatattattttgtttgtaggtggctataagtatgttctaatcatcgtcacaatgaaaaaggaatatttttctagaaaataaaagtctgttggaatgtaatataccgaaatccttagttaaaagaaactactttgaattcaagctcgcttggccatactaggtcttgaatatagttactatactttgatagtgctttagtttattgtatttgccaaatgtagtttctcaaaagtggacacagtacaattatttccatatttcaatatcaactgacagttaatcagcaacagtaaagaatgatatgtgccacagaaaaaactaagtatttcttcagaaaacaaaaggagattaagttgatttatgctataactaagatataacttacttataaacacttggataattctgaagggttggttgtatcatttcatgatgtaatagttatcattaaaatggtcacaaaacataatggtcattgctggtaggtaaaaatgatacattatatcaaattagacaatgtcactgcagttgtaaaggcatcagcttagctcctttgagttatgccagatgggtaacaatattgctaagatttgtggatgattttgttaagagtgaatcattagtaaaaacaggtgattgccaatatgttataaaattgaattcaggctttagaaaataaattatttgagactgttgagaaggaaccaaggtgaaacatgagcaaactgtaaccagcagactatatttagactatatactgaattttggaaaattttgaaaaatacataaaacttcagaattgactattataaatatttgattatatttatttaaaacactttaaaaataaaagaaataaaaatagaaccttacaaaattgaagatccatttttttccccctcctcagtaatattctccaactccactccctgccctgtccccacccaaaccctccacccaaggcaactgctgtcagggtgtggtagttaaaaaagaaaactttacataaatatgtatctattaataaaatatagtaagctttatgtagttttaactttacttttatggtatcattctatacatatcattatacagcttgatattttcacttactgtcatattttgagatgcatctgtgttaaaaaacattgaattagtttattccttttaactactttatagtgttttgtggtatgaatacatttaatttatttttttgctgatcgtagtaaacataggttgtttcctgacattgattttctagtaagaagctcgcccagagaaagtaaatgtatttttaaagaaagaccaaaaataaatgtcatgataatctaagaatttaattccgtaattatacagaatatatctctagatttatatatttatttctctaaaaatgtatatgaattatacaatatttaaatatcagaactatctacagatagaaatatattagtaatagttgtttttttttcctttttctcattgtcaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggtaagcatggaatatatatattcatacacgttatggttttcttctttaactacagcaagagtaatgacatagggaataattgatacattattttctgaggataacatcgtaattcactttttattcattacattaagctttatccttgaaacagctcagcttttcactcatcagtaacagatcatgttttaaaacgacagacttcttttttctctcttttgacaagattgattatacagtgcaaactatcttacataaatctgttttataaaatctctagggagttaaaatttcttcagaatgtaactgttgaaggccagaagcagaaagtgaggatcttgttatgttttgtttccaaaacagttgaaaattttctttttcagaacctccaacactagctgatctttacacttcttcaaatccatgtgttcacaaagcctcactgccacttttttcacatccatcctcttaggtgacatcagataaaagacagggaggctatctggggactcagaagatcaatgctgcataacactaagtcaccagaccgtgggcttggccccaacaataccatatacctttcagccttatttttttgcttttgttttagcagtgaaactctaatatagtaaagcaaaaatctgtccctactctgcttgaagtatgattgttaggatcatagctgacccaccttagtcctctctttgttccccttactttatataacttcaggaaacccactatttgaaaactgccattctggacagctcttctatttccaatgtttcaagattccaaaccagatgaatccttgggccttaagatttcacagtttcattaaaagttccctttagtacctgcctggttgtgtcaccattgggtggctcaaacaggacattctgtgcataaaacagaacatatgtgtggccagtatgttgtagcagttacatgagtcaagatgagagaataggcctcaagctgtggatattaagccgttctgaaagtttgccaggcagtaaaacttatctttacgacagagtccacagtgcagcaaacaaaaagaaaactccctattatatgagaccctagaaataaagtctattctaaatagcacaaagtgaagtatgttgatttacagtaggaagacttgagtatttttattggagtatttaagatagaagataaattatagaagtctgtttcattcttcctcttctcccataaaatgtatatcgttataacttactactttggagaatggaagaagggggactggaaatgaaaaaccagatgataaaagagatttgaggcacatcttaagcgagtttatgtgctcagtcagatgagaggggaattgaagttgccaaaagaagaatctgaaggccagcaactctatcatatttatttatatgttttctagattcttcataagtgattctttgcaaaatgcatgctgtcagtagtgtataactcataaagggcacttatttatggaacaatatatttttaggaatttccagttttccctactgaaatggttaattttatatgtcaacttgactggaccacagagtacccatatatctggtcaaacattattctaagtgtttctgtgagggttattttttggaatgagattggcgtgtaaatcagtagactgagtaaagcagattgccttcataatgtgggtgagcctcattcaatcagtcaaagtcctgaatagaccaaaaagcctggccctcctttaagtaagagagaatttttcctgtctgataggctttgacttggaataatggctttttccggtctctggactcaaaatggaacattggctattcctgggtcttaagcctgctggcttttgcacgggaactacaccattggttctcctagttctcaggccataaggcttgaactggaactaaaccattgacctcctttggtcttcagcctgtgaaatcatcctgcagatgatcttgagacttctcagcctccataactgcatgagctaatttcttaccttataataaatctctctctctctctctctatatatatatacacacacacacatacgtatatatacatatatatacacacacacacacacacaaaaacataagtacacgcacacacacaccctattctgaccctgaccaataaacatcctaccctgcgattataggcttagtagagaatgtttgtggcagtgcattaataccagtatttttattttttaatttttgtaggtacatagtagatgtatatattaatgggatacatgagatattttgatacaggcatacaatgcataataatcacatcaggataaatggggtatccaccacctcaagcatttatccttcctttttgttacagataattcaattatacttttttagttatttttaaatgtacaataaattattgttgactatagtcgtgctgttgtgctatcaaatactagattgtattcattctgactattttttgtactcattaaccattctaacttccctcaaccccctctgccccaccgccaccaccttctcaacctttggtaaccatcattctactccctatcttcatgagttcaattgtttcaatttgtagttcccacaaataagtgagaacatttaatgtttgtgtttctctgcgtggcctatttcacttaacataataacctccagttccatccatgttgttgcaaattacaggatctcattctttttaatggcttaatagtactgcattgtgtatatgtagcacattttcaatatccattcacctgttgatggacactttggttggttccaaatcttgactgtggtgaatagtgttgcaacaaacatgagagtgcaggtatctctttgatacactttcttttcttttgggtatatccctaggatttcctttcttttgggtatatacctgggagtggaattactggattatatggtagctttatttttagttttctgaggaatctccaaacttctccatagtggttgtactaatttacattcctaccaacagtgtatgagggttccattttctccaccttctcactagcattcattattgcctttcttttgcataaaagccatttaattgaggtgagattatatttcattgtagttttgatttgcatttctttcatgattagtgatgttgagcaccttttcttatccctatttaccatttgtatgtcttctttagagaaatgtctattcagatcttttgcccattttaaaattggattattacatttttactcatagagttctttgagctccttatatattctagttattaatcccttgtcagatgggtagtttgcagatattttctcccattctgtgggctgtctcttcactttgttgattgtttctttggttgtgcagaaactttttaatttgatatgattccatttgtccatttttactttggttgtggggtattactcaaaaaaatctgccagtccaatgtcctagagagtttcctccaacattttcttgtagtagtttcttagtttgagatcttaaatttaagtctttaatccatttttgttttgatttgactttctgtgtatggtgagagatagggatctagtttcattcctctgcatatggatacccagatttcccggaaccatttattgaagagactgccctttttccaatgtacgttcttgtcacctttgtggaaaatgagttcactgtagaagtacggatttgtttctgggttctattccattctgttccattggtctatatgtctgtttttatgccagtaccatgctgttttggttactgtcactctctagtataatttgaaatcaggtaatgtgattcctccagtttttttctttttgctcaggatagctttggctattctgagtcttttgtagttccatttaagattatttttcctatttctgtgaagaatgtcattggcattttgataaggattgtgttgaatctgtagattgctttgggtagtatgaacatgttaacaatactgattcttccaatccatgaacattaaatatctgcatttttgtgccttcttcaatttcttgcatcaatgtttttcatagatttgttttggttttttgagatagggtcttgatcttttgcccaggctggagtgctgtggtgtgatcatggcttactacagccttgacctcctaggctcaagcaatgctcccacctcagcctctcaagtagccgtgactacaagtgcacaccaccacacctggctaatttttgtagtttttgcagaaatgggattttaccatgatactcaggctggtctcaaactcctgggctcaagcaatccaccaacttcagctatccaaagtgctgggattacaggcatgagccaccatgcctagccagttttacagttttcattgcagagatctttcacttgtttggctaagttaattctcaggtattttattttacttgtggctattgtaaatgggatttttttaattttccatatggttcactgtcggcatatagaaatgctactgatttttgtatgttgattttaaatactgcaactttactaaatttgtttatcaattgtcattttttgttgttgaagtctagttttttccaaatacaagatcatatcatctgcaaacaaggataatttgacttcttcctttccaatttggatggactttatatcattctcttgtctgattgtcattaaaataattgccatttaaaataattgtcattattttaaaatgatgtcatcttattacagattgcataaacatacaagtgaactaacaaacaagcaaagaggaaacgaataaaaatttgacacctaaactttgtaccccactttttaactttttgttgtttctatttatatcttattatatactgtctatgtctagaaaagttgttgtagttattattttttatccgttcagtgtttagtctttctacacaagaaatgagtaggttacacaccaaaattacagtgttatagtattctgtaattttctgtgtccttgctattaaccatgagttttgtacattcagatgatttcttattgcttattaatatctttttcttttaggttgaagaacttccgttagcatttcttgtaggataggactggtgttgataaaatctctcagctttgtttgtctgggaaagtctttctccttcatgtttgaaggatattttcgcttgatatactactctgggataaaagtttcttcagcacttactaaacatgtcatgctacactctcctggcctgtaaggtttccactgaaaagtttgctaccagatgtatgggagctccactctatgttatttgttccactttacttgctgcttttaggattcttttttttttttaaatccttaacctttgggagtttgattattaaatgccttgaggtagccttctttgggttaaatctgcttggtattctgtaaccttcttgtacttgaatactgatatctttctctacgtttgggaagttctcattattaaccctttgaataaactttctccttctatctctctctttacatcccctttaaggccaatacctcttggagttggcctttggatgatatttatagatcttgtatgcatgtttcatttttattcttttttcttttgtttcctctgcctattttctttctttctctttctttcttttttctttctttctctttctttttctttctctttccttctttctttctttctttctttttctttctccttccttccttccttacttcctttctttccttctttctttcttattcttccaatccgtgaacatgaaatatctgcattttgtgtcttcttcaattgttttgcgatgtcatgttttcctggatggtcttgatgcttgcggatatttgtcaatatctggacattgaagacttaggtatttattgtagtcttcacaatctgggcttatttttacccatccttcttgggaagtttttccagatatttgaagaggcttgggtgctgtgatctaaatttttggttattgcagccatatctgcattagggggcatcccaagcccagtaatgctgttgctcttgcagactcctagaagtactgcattggtggtcttggataagatctgggaaaattccctggattatcaggcagagactcttgttttcttcccttactttctcctaaacaaaaggatcctctgtgtctgtgctgaacttcctggagctgccagagggttgattcaaggactcttgtggtcactgccactgggattgtgctagatcagacctgaagctagcacagcactgggggtctcacccaaggcccatggtgaccactgcataacatatatcatagtctaactaataaaaataaaggcaagaaaaatattgaaagaactgagaaagaaaagtaccttatctttagggcaaaagcaatcggaatgacaggagatttctcatggaaaaccatgggtcccaggtggaaatggcacgctatttttcaagtgccaaaagaaaagaccctccagccctaaattctatatccagtgaacatatctttcacaagtgaagaggaaattaagatattcccagatgaaggaaaaactaagaatttgttgcacacagacctaccctgaaagaatggctaaagaaagatctttaaacagaaagggaatgataaaaaggaaagaactttggaacatcaggaaggaagaaagaacacaataaacaaaagtagatttcaccagaaaggatgtacagatgaagaataagcatataaaatgatgttcaacaccattagctattagcaaaatgaaaccacagtgggatatcactagatgcctaccagaatggctaaaataaaatccatgacaataccaaatgctggtgagaattcacagagactggatcacttattcattgctgatgggatgcaaaatggtaagccactctggaaaacagtttagaagtttcttcaagaattaaacatgaactaccttatgactcaggagttgcagtcctggacatttattcctgataaatgaaaacttatgttcacacaaaaacttgcacatgaacatttatagtagcttattaataatagccccaaagtagaaacaattcaggtgtccttcaatgggtgaatagttaaactgtggtatatccatgtatggaacactcctcactaataataagaaacatactattgatacacataacaacctaatctccatataatcatactaagtaaaaaaaaaagctgataccaaaagattatgtactgtatgattccatttctataatattattgaaattacaaaattataggaatggaaaagaaattggtggttgccagagattaaggagggaatgggctggggtgacacgagtgtagctgtagaagttaacatgcagaattcttatggggatgaaaatgttctgtctcttgactgtatcaataacaaaatcctggttgtaatattatattacagtcatgcaaaatgttactaatgaaggagtttgggtaaagggtgtaggaaatctcctttattatttcttataactgcatgtaaatctgcaattatgtcagaataaaagtttaaacaattggaaatgacagtttcacctctctggtattattttattttcctgttgcttaattgcccttgtgttgttctctaagtgctaggcatattactagaagacagagacatacaattctcttttccagtagctggcatgaatgagaaaataattatggatcaagttgttattctgttatgatattgattttcattttactttaaatagattaatgcaattaaaacagtcattgtaacatagataccctttggtagaccagcattcccatgtacgtaagtactgtagccttagcatctgtggcttatatctaagtttgtgatataaagttaagaaggaatttctggtccttcctatttgagacaataaagacatctattattctagttatctttcagttaaatagacctatagctaaaaacaaatttgaaactgattccaaatactttcttttatatatgtgtgctagctgaaagcacacaagttcaagaaagaccatgtgttttccttattttcacgttgcctattccattcaaagactatttctatattgattttctttttttttttctttttttttttgagatggagtcttgccctgtcgccctggctggagtgcaatggtgcgatcttggctcactgcaacctctgcctcctgggttcaagctattctcccggctcagtctctcgagtaactgcgattacaggcacccaccatcatgaccggctagtttttgtatttttatagaggtgacatttcaccatgttggccaggctggtcttgagctcctgacctcaagtgatccacctgccttggcctccccattgtcacttttaaattgcataattcttctttgtgtttattatatgtattttataaacacaagaacattttgattgtttcatttcctttaaatatttgaactatgaaataaatcctgcgaaaaaacagtgggccaaatgtatacatacagtttttagtaatcaaatcactaccaccttgtttcagaaatttaactttatctgaattttagtataaaactttccattatgaacccctctgatgccatcttgctttttccttgactatccccaccttgcagataatttatatcttgaattttatgttaaattattcatattctttttaagtagttctattcttatatattatttgggtttacctgttttggaaattgtgcaaatgaaattaatccaattgtattgttctatggtccctgttttgttcaatcatatgtctgtgaactatccatgctgatgtgtgtacttgaaatcctttcattttaactgttatatagtatttcagggaatattttaatgtatccattctaaagccattagatttttgagttatttccttcagtaaggctttttattttatcgttacactgcagatgctcttaaaaagcattcattgattttttttttcattttttgacacaatcaatcacttcctccttcctgaagaatgctcttctttgggcttttgtaataacacaccttcctgctcttaatccttacctcacttggagctccttcctgttggctatgttggtcttcctagccagtaaatgttgggatccaccaagaatcaatctccaggctagactatatagaactgtttattaaatatcatctgtacactgaggacttccacatttttatcactaacctcatcacctctcctgatccagacccatgtatctgattgctcttacgtgatgtcgtcacttgaatgtctaagaggcatctcagacttactatgtataacagataactcttgatttgtcccttaacaatattttccccagttttccaccattcattatccatttacccattcatctaggcaagcagctaggagttaccttcacttctcctcttccttccacccaatatcaaattcatcagaaagttctattgactctaagctgagcgtagtggtgcaagcctgtagtcccagatacttaggagaatctcttaagcccaggagttggataccagccttgttgatatagcgagaccctcatctcgaaaaaaaacccaaaatgaaacaaacaaaaaagtcctattgactctacatttaaatatatttctagtctgagtgcttctactcatgtgtatttctagtctgagtatttctattcatgtgaccctatttattctaccactgtttcttgcatgaacgaatgcaaaaacctccatgctcattccctactatatcctaatatacacaatagccagaacactcatgaataatgataaataaaatgtgtcattctcttgcttgaatcctctagggtcttcctgccacattttgaataatgaacctacatgcctacatgatctgactcctatctacctctctgttttttgtttttgttttttgttttgttttttgttttgagatggagtctcactctattgcccaggctggagtgcagtggcataatctcagctcactgcaacgtctgcctcccggattcaagcgattctcctgccgcagcgtccccagtagttggaattacaggtgcttgccaccatgcccggctaattttttgtatttttagtagagatggggtttcaccgtgttagccaggatggtcttgatctcctgaccttgtgatccacccacctcagcctcccaaagtgctgggtttacaggtgtgagtcaccacacccagcctccacctctcttacagcagcatccagcactctccttctagtcacattggccttaggttcttccttgaacagactaagatggttcccatctccagtgcctttgtaattattctttctgcctagaatatttcccaagatccttatgtagcctattcatttatttccttgcagtctctgttcaaatatcacaagagcttctatgtccagttttatataaaatgctaccctttccatcaccgtgcattcccttacctacttttatttttcttcatagaacttgtcttcaggtaaaaatctatcattaattccacaacccttgtacaacctgtatcctctgctagaatagtaggttctatgagtgcaggtattctgctgttcaaatctatatccattgtatgtcacttggcttgtactaggagtttaatagttcttggctcagtagtaaataaatgcacattcctttgattcttccttgactaaagtgttcatgcttcacgttccaaaacactttttccaagaaaacttttcaataaccataatttgaagaagagcagaggtatatatgtccaggaccctactccttaggatatttccatatttgagtgtaaacatgaaaccaatttcttctacttctgctttcctcccctctgccttctctctactctccccagcctgccccccaaaatttctatgtgacagtgaaaatataaatattcctccttttcctgcatacttatattttaccacatgtgttatttgaagcacgattttcaatcacaattggagaaatggaggcaagagtgacatttctggtctaatttgcttccttggtccatttgaaggcatctctttcctaatctcatcactgtatgttatgtatttatctctctaatttatcttagcagattatgaaaagtataaaaccccatctttaggtagtactgtcatcatcattgcccttcagtttgtttaagagaaattgaatttgtttaagaaacaagaatttgtttaggacaagatcagaggtgtcatagattcacttaaatggtgttgtttaatttctaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaaggtaagtttttgtgaatattagtaatttgtttagtgaaattttgtaaatttaaaaacccaagtaaaaccaaaatcacattctcttttaacattggttattatgaaattatgataaatttagatttctgaacataggaatagaatgcatcatatctgacactgtcctcttccttggatatgactgatgcctctttggaaatctcagtcttaggcttggagaatgacctagtgcagtagtaaagacagcctagtgcatgaaaaaaaaggctccagaggttgggagctataggcagttggcgactctccagaaactggccaattaactttgtagtttgagcctcagtttttttagtccattaagaaaaaggacttgagctagattatctacatagtccttccagtttaaatgccatggaatagaaattatcaccctctgcttgttctttagtcctcacgggcactgaaaactttcacagaaaagaaaaattaagaaatgactagataatttcagacattccatttggtatatacttgtacaaaacagattttattttaaacctatttacttacaactctgcaaatgatggaattaaatggagatgtgagagcctaagaatataaattttgaaagatatctataaagttattacttaaaaaaaaagcctcctttggaggtttactttgggctttcttatcaagatatttcctatcaatatatttatatacaagaactgaatgttttgagtacatacccatgaatgtataattactacatctcttacataatgaccttaaaatactttagatgttaacaatggggttttagatagtcgtgcatactttccatccagtggtatctcttaaaatacaatgcttgaaagatagaaaagaaaattataaagtacagaggtaaaaagagcaggccatggcaaacatcttataaagcaaagggaagcgattgctatttcatgcagagaaaattctgcagtaaaaactcactccacaaaatattattacttgaattttctaatggcccaatggcgtaggacaatgccaagttgtttttggccagggaaagagaaagaatgtccagtaattacattttagggaaggaaacaggacctcacttcatatgatttagggaaaatatatggaaattctgctactttttgttctcaataagttatgtatgttaaccaagttattattggttaagaatcaacacttatttcagtagagttgtcagatagtacatcttgactgttactagtactatcgtgaataatacaatggaattataaaagtagctcctatgggaaaatgtaattaactttttttgagtaaccattagcaaacagtacaattttctcatatatgaagatacttaaataaataacctgggaatacttggagggataaaatatattttaaatgttataaaaatattgtaatattgtaaaatattgcctgtaatcccagcggaggcgggattgggaggcggaggcaggcagatcacttgaggtcaggagttcaagaccaccgtggccaacatgtgaaaccctgtctctactaaaaatacaaaaattagccgggcatggtggcacatgcctgtagtcccagctatttgggaggctgaggcaggagaatcgcttgaacccaggaggtggaggttgcagtgagccgagatggtgccactgctctccagcctgggcaacagagcaagactccatctcaaaaaaaaaaattgtaaaatcaagtagaaaacatcatttgaattcttaaaagaaaatgactagtattttatttcagccaaagccttctttgctctggttattttcaaatcaagttattgtcactacttttttaaaaatagtatgatataatgtactctcaaattccttttttatatgtacatcaatactgaaatctgttgatttaactgacttatttaataattatagaaatatatattacatatgtacatacagaaaatatataaagaaaacaaaaattctactaacatagacttcagtaaatggaaattcataccttgttctgcaataagaagattcaatatatggacacaacagttttctgtaaattaacctataaatgaatcgtaattcctatcaatatatcattaggttgttttggggttatttttacattgataaaatgatactaaagtttacctggaaatgtaaacatgtgaaaatgggcagaactttcctgaaaaagaagaaaaaaggagagggaccttgccctagcagatatgaaaacatatttgaaatatggtgttactgtgattaaaggggcaccggtgcagacataaacattcacatcaatggaatagaacaaaaagttcaaaaactgaagcatagatgaaaattttatatgtgataaagtgctatttaaaaatcaatgggtcgaaaatattattcagcaaatagtgttggatggctgatgtaaccatttgaaagcaaaatagagctgaaccttatcctaaattctacccccaataaattctagacagatcaaatatttcagtgaaaaactgaaaccatgaaagtagcagaaaacgtggatcagtcatttcatcgttttagtttagaatggggaagatctttccaaagcctcagacaaaacccagaagccacaaaggaaatgactgataacttgaccacatacagtttaaataaaatttctcttagcatacaccaaagcaaagtgaaaacacaactaatgagtgtggggaacatttttgcaaatacacgtgtgatgagaatgtttatttcagcattacttcttataacgataaaaactgggaaaaacgatagccattatgaggggcctgactaaatgaatgcatgaaatgtatttaaaagtgcaagaaatacatattttatattttaagcatagcaataataatgagaataataaaacaagaactgaaaatttggattatcacataaagataaggtggcaaaatttaccaaataaaaagaaggaatgctcagttaagtttgaatttcagataaaccacaaatacattttttagtataagcatattgcagatacttatttgggacatatttataccaaaaagttattgttgcctgtctaaaattcaaataaggtcatttgtactttacctggcaaaccatttatatatgccatatgaaattatatacactctaaaataacctcatattaaaaaggacagaatagaacttccaagtactggaaggtacttcattctgtaagatattatattttaagtgaaattgttttacatttttaaattttattttcccccacattctaagttctttgaaacaaaatctattatatacaatgtatttcttttaaaagatctcaataaatcttaagtaatattattacacatgctagaagtggcacaagtattatactaaaaaagagcatcagctttaaatgcctcactataaagactttctgtatgaaatccagctgtgggttcaggcaaatttttgctatgacagaatattctatcccctgattttcccaggcatagtgaaataaaaaatattttaaaagctcttagtcgtcttaatagcaagagcagtctaaaacccccctgaatctgatatgctaactttcaatttcgtcaggttttgattttgtcgttatcaaagcttggcaaagcccatcaggaggtgttgactctaattttttgttctgaaacacttgaaagagcacaggaataattagttctgtaaaagtttgatagactatcccctacctccaaaggcctccgtctttgtcttctatcctgacaacttcttaagttttttccatggttgattcaggtcttctacttgttcgtaaggcaattttaataatgttgggagttcttttgttgtttgtgtaaactggccttgtggagccagcctgtttcttttcatcatatactttttaataacagataccttatatttcaagaattagtttttacacttgatttattttgtaatcatactaacaaggattttgagttaactctgtattttactggctggttttgtatttcatgctcgaggtaattttgactgacttgtctgtgaactgagtcagtccaggtggttgctttggcacaagcaagtggggagtgttgccaggcagtgtagggcggctgtcaggagcacctcctaggcttcgtggtcaccaactgtgtgcgaacacaattgtgcgcaaacaaaaagaacaagttagtcatcctccttctgccttagtttccctaactggaaacaaagacaataggaccttcctcacaggttgttgtgaagagtagttgctagaaagtgctgaaaactacaaggtccctgtactaactgagtattatagaaatggcctttttgtttcagttttgtgtgctttactaaaagaaactttgtttttttttaatatgaatgaaagtgtgggtagccatagaatgcctggatcacagcctttaattcttacaattctgaacatattgcttggctggcttctgacatttcatttttagaaaagtcggaagttaaactaaatttttgtttttctgttggtaatttttttcctgtctggtttctggtatgattttttttttactcttgaaataatattttttaaaatcacccaaatatatctggtgttgtctctttttctaattttccctagtataaaagcaatctctacatttttagacatgaatattcttcagcattttaaggagctgtgttattttttgcctctgcctgctcttttatatatagaattatatcttagggatttgtcaagatttgtcctactagcctgttatcttttctctgagttctgggagattttcttgagcttgtttccatttatcatattcagtttgcttgtttcagtatccagtggttgtgctctgtctccatttgtaatttttgcattgctaaatttttattctgtgtcttttacatttccctgtgggttattctccactctgccttactatgtgggagatgactattcttataaatgccaatcttgagctctaccatgagcttggaactgtactagattacaaagtcataaaaaaatgaggaacatgatccactttcacgatgagcttgaaacagataaatcatttcaaggttgtcataagttcactgataaagttacatgtaagttacaaagagagtgataatgtaggttggtagatggggcatagtgtaagaatcatagagcttgaaacagataaatcatttcaaggttgtcataagttcactgataaagttacatgcaagttacaaagagagtgataatgtaggttggtagatggggcatagtgtaagaatcatagagaaagtgatgacttttagagtttgaggaagtaatagggacttatcagaaggtaatggagtaagtggcttcacaccaatgcttaaacgataaagatgtggtcctgtgtccggaattggtgggttcttggtctcactgacttcaagaatgaagccgtggaccctcgcagtgagtgttacagttcttaaaggcggcgtgtctggagtttgttccttctgaggttcggatgtgttcagagtttcttccttctggtgagtttgtggtcttgcgggctcaggagtgaagctgcagaccttcgcagtgagtgttacagctcgtaaaggcagtgtggacccaaagagtgagcagtagcaagatttattgcaaagagcggaagaataaagcttccatagtgtgcaaggggacccgagcaggttgccactgctggctcaggcagcctgcttttattctcttatctggccccacccacatcctgctgattggtccgttttacagagagccgattggtctgttttacagagcgctgattggtccattttgacagggtgctgactggtgcatttataatccctgagctagacacaaaagttctccatgtccccactagattagctagatacagagtgtcaattggtgtatttacaaaccctgagctagacacagagtgctgattggtgcacttacaaaccttgagctagatacagagtgctgattcatgccttcacaatcccttagctagacataaaggttctccaagcccccaccagattaactagatacagagtgccaattggtgcattcacaaaccctgagctagacacagggtgctgattggtgtgtttacaaaccttgagctagatacagagtgctgattggtgtatttacaatcccttagctagacataaagatctccaagtccccaccagattaactagatacagagtgcctattggtgcattcacaaaccctgagctagacacagggtgctgattggtgtgtttataaaccttgagctagatacagagtgccgattggtgtatttacaatcccttagctagacatattctccaagtccccaccagactcaggagcccagctggcttcacccagtggatcccgcaccagggctgcaggtggagctgcctgccagtcctgcgctgtgtgcccacactcctcagcccttgggcggttgatgggactgggtgccctggagcagggggaggtgcttgtcagggaggcttgggctgctcaggagcccacggtggtggggggaggctcaggcatggtgggctgcaggtcccgagccctgccccgcagggaggcagctaaggcccggcaagaagtcgagcacggcagctgctggccaaggtgctaagcccctcactgcccggggctggcagggctggctggccgctgaatgcggggcccactgagcccacgcccacccggaactcgcgctggccctggttcccgccctggttcccgcctctccctccacacctccctgcaagctgagggagccggttcccgcctcggccagcccagaaaggggctcccacagtgcagcggtgggctgaagggctcctcaagcgcggccagagtgggcaccaaggccgaggaggcaccgagagtgagcgagggctgtgagggctgccagcacgctgtcacctctcagtcccccgtcattttggatttttcctccttttttcccctgtctctcaaaaaaacaaataacccagtttttttttagtaggaagggtcatacttactgaaaaaggcaaaagctcttgactaatcttgaaaaggattttctcatttggtgctttaaatatttagtgattatggtagcttctgtttactggaaaaaaataattttgccactattataaacaaatattcttgaggtatttatttccttatttgttggtcaaaagaataagaatccctagggtagatgtaaaagtgagactaattttaactcatgatgttaattattgtagttaaaattaaataatctgtgcaggcatttaggactttatctaatgattaagtagaaaatattttggtgattatgccttttctttatagatgattacttatgccttttcaactgcaaatatatatatttgaaatataattttgataccaatttctcttaagttttcataggtttatccttactaatgttaataactattaataaggaacacacacacatatatgtatagcatataatttaagaaatttatttttatagatatatttttatacttagattctttttccagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaagtaagtatcttttaatatattagcagtaccttttatgcatttttttcactgtttacaaagcaatatgtaatgcaaaatgacatttagatgatgtaactaagaatgatacagtcaatgcattgtaccacttggaaagttgaagttaattatttgaaggaaacatagcaggtacatcaaaaaaataaatgtatactgtcaacaatatattccacttattttgaagtgttttttgaaaataacaaaagccttactgtttactcttatttatttaatgagtgaaagatacattctgaatagaaaaaaaaagagagattacagcctttaggagtgttttgatgtgttattaattgtgctttccccaatcacaaacaactgtgattgttctgtccatttggagacaactctcagactgttgttgaacttcagactagttgtcggaaagctagcaagaggaaaaggaaaaaataaaatgtggctcatgttcattattaactacataattaattttataactatatgttaacatacctctatgctataggtactatactaattacctctatattaactatatatatatttttttagatggagtttcgctcttgtcgcccaggctggagtgcaatggcggggtctcggctcacttcaacctccgcctcctaggcttgggtgattctctcacctcaacctccctaatagctgggaccagaggcgtgcaccaccacacctggcttatttttgtattttttgtagagatagaatttcaccatgttgctcaggctggtcttgaactcctgggctcaagcgatccacctgtcttggcttcccaaaatgctgggattacaagcgtgagccactgtgcccagcccaatgttagttcctaggtcacaagacatacgaagttcaaagagatagtcaatccagatagaaaaaagttataagaacaaggaataaaataataatgatacaaatgatattaattatacctctgctatagtcctgacattgatttaaattgaacaatatcgattgcctttgttaataggtaaaaacagtataatgaaatttccatgtggttcaacctaatccttgctaaaagttgtacatattgttttgtccttacagagatcattttaagtagctattcaggatttgagtgagggcttttaatacccctatttacagatgtagacactaaggctagaaatcttacacagcttgccaagggtcacacaattagttcatggagaggcctggactcaaccccagacttacttgagtctacagcccctgctggacacctgtggtcagaatagattgtaaccacctacttcatagcaaaatctgccccctccagcccatggctctgaagtgccctatactttcatcccagatcagtgctagggtgtgacttgaggtaaaggtacagaatcaacatatccctatactctacttttcctttaattttgatgagtgagtcctggaaattgaggttttttcttaatgtgcaaaatcagaaaagcctcacatggggcttttgaaaggattctccaatcctcaccactgctcctaaatgtccatctgagaccaatgattaacagttcagctccttagtgcctcttataaatgtctctaatgctgtcttcagaaacctctgaaatggatcatttatttgcttcaagtaagtttgcactaagtgaggccacagtatgcatttgtgtgtgtgtgtagtcaagaatacctgttattgttttcccctgttgaactatgttcaactattttgttcaatgaaatcaagcagttcatagctttgcaatccccacaatctcattcttcttttccattttccctatatctctataagatcaccagcatgttaaaatcacaaggttgtcttagatgtgaaccatctaccttgctgtgcatgttgagtcccatatctatgccttcaagggcccagtgaaaactcaagagcttataagatgcacagaaagagtggccttttctgttttgttttgttgaatgctgtattcactgggcctagaacaatgtctggtatgtggtggattttcaatggttacaataaaatgagggagtagaatgagtaaatgaatcaacatgttttctgccatacgcttccactaaatagacttacctttccttttgagttgtccaggaagaggaaacagcatgtacaatggcagtcaggcaagaattagcatggtatgtttggggagctcatcagttttttaaagattgaacatggagtaagctaggtagggtgtgtgtgtgtgtgtgtgtgtgtgtgtgtgtgagagagagagagagagagagagagagagagagaatgaatctgactttggattttagagacattatgttgagaagagtgttaaaggttagagaatagggcaaataaagaaataggaaaaccacataggggattactgttcaggtaaaagaaaatgaggactgaaattaaggcagggacatgggagggtggtaccttgaaaacaattaggtggtagaattaatatgaagatgacaaattgaacacagaaaataagagagagatcaagactagtttgtttactcaggaagccctaaagatgctgaacattctgatatgcattatttatacattgtcttgagcaatattaagggagtctgctgagagttaagcatttggggagtgagcaaggatattgaggagaatgacggaatctagaacaatcacttggaagccaagtaaaaataatgccaggtggcactgagggtccaactgaggttggtcactgtgaatttgcggtggtgccaatctacatgtcaatgtgggagttttccccctcatatcaacttaggtataaagcagactgtgggattgatcaaggtgaatgcatttgagggacataggtgtcataggataaggtatcagggaaattatggttatcagcaaatagaaggtgtcaggaatttgttatgcttgcatcaagcttaggaagagtcactgcatgtggtgatgttcttagtttgacaagataacagagtccctgactggactgagtctcagtagatgacaaagggtgggaggggaaaagggatgtggagtcatgtgtttgaggttcactggtctcttccacattgtatctggtcagggtgtctgcagtgacaccttttaggctgagagtcaccattgaagatgtggtgacttcagattaaaagatgagattttgacaagctatggtggaggtggaggtatgtgaggtccacacaaattgaggtgtttcaataggagacatggacaaaggacctagagccccaggtgaataagtggattcaattcaggtatttgaaggcaccaattcaaatagggtagctgaggttacagaggagattttttgtagagaggatgtaccactacaggaaaaagttggcccttactctttcttttcctgactcagtttaaaattctctgctccatttcctacgtctggggtcttgacaagatatcatgtaaatctacgacgtagttgtacatactctacatctattgtgacatatataacttttaacatttaatgcataaatcttatcccaacattctaatattctctcaacttttccaggcaggtttaagatctgatttatctgtgtgtctcctgattgtttgcaaacatgatgggtcagccaacaggatgcatctgattctctgggggactggttacaaatataaattcctagaacccctaatcccctccttcagtagggattctgatttagtaaatctgtgatgtaatctagaaatctgtactttaaagcaaacttccaagtaatttcaatgcacactgaggtttagaagcaatttcactgagcccaggctcttattatgcctagtagatcttcaaaacagacttgttaagtgaaaaaagatcactgttcagtgctgtttctcttatcagtcaaataagattatattaggcaggctctggtggattagaaaggcatgaggtaaactcttgttgaaaacatgggcctggatatataaggtttatgatgttcttaaataaagtgaagggctttagctcagtggggggacatgcttttctcaacctattccagcaatgctgatgtgactaacatagaaaagcacacttttaaagccacagatttcatctttatggccacagatttcatcttgatatccataaaacagttttcaaaaacccatgttttaggttactaggaggatcaagcaagaggatgcagaaaattctgtgcaaaaaatcatgacaattatccacaaaagaactgaaggcacattctatttactgcttctgggtttgttgtgttattgttatacatgaagaatagaatccaagtgtaatgcactttaacaaatataagtggatatatgtattcaaatacatgccatttttacagaccctttgcttttctgttgtagaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtaatctttcattcaaaacacttatgtggttggaatctgatttatttctttagcaggcacacttggaatgcatttgtttgatcacagttttggtaagtgctacacatggtgaactactatgaaatgtgttccatctttatgaactatttgtagaaagtttagtttctaaatgagttggaaatatatccttcatgttttgagtaaaatacatattatatatgtggggaaagtaaaaaatatatagctttaactaatatactattacgtacttaacttttaatgaagtcatccagttagagtcaaagtgagtgttgtcagctgaagactgctgaatggctaaggcggggtagaaagggcacaatggaaaaccaatcagatgtcctgcatgcataagtgagctaaatactaacagtgaaagaaaacaaatgactgtagctactagaaaaatgaagtcaagttcagggtaagagactcagtcattacaccaattgtaaaacatcattatatgttctgtttttaacattctaggtattatctttgagtgtgaaaggtcagagttcacaactcctgactaatgacaatgaggttctctacaggatttatgctgctgagcctagaattattcctcagacatctctgtgtctcctttggaatcaggctgctgcaaggtacttattaataaaataaaaaaatcagaatttggtccttccccatttcggtaccactgagcctaatgttttgtactgagcatagatggtggccccagatgacattagactggaaaataacctccacaataaataagaggaagcagcataggaaatggtctagtattgttctgatggcaaatgcagcccagcatttcaatatgtgtgtaacacattatttacttcttcatttttactactttcacgggatgtggcatgaattctgctcaattctgataaccttgaagttactagtaaatttattgggcaggaaagaaattccttcttttaccctttccatctgggcttgtggttctggaaactgatgccttgtgtttaagaagaatcagcaggaatttataattctagtccacatggcttgaagtacattttgagattaaatccatggacacaaatgggaaggaaagaatgattctttttttgaatctcctcggcctcaggcctcaaatttctgagcagttacagtcactaggagctcagtcaatgctgcaggatcaggcagtgctggcctagaagggtctagggttcctgtcagccacttgattttgtttattactgaatttcagccacacaaactaaaattctaaataggtttaatacaatagcttagtttggtaaccaactttcctcaaaaacactgaaatttctgctttctttctcttaaaaaaattccacttgaaatttcttcctaggtttaaaacaaatcttaaacctaataaatagaaatactctgaaatcttcaatatataattaataatgaatgtttcaagctgcatctggagtttgggtaaggaagttttaggtccttaaaaaagtaaagaaattaagaggcattttaagggaagaggctcaagtgatagtcactgaggaaggctcagaaggcttggcatcagatacaatgtttgctaaaattatgacatggtttttctgctaaattagccagaattcataaaggaaacacttttaagaaccttagaaaacatacacataagtcactccaaagtagaaaaaaattgaggaagaaatcttagataaccatacaagtaatttatatggttcaaaatacaaggacttgtggaagaaaaaaaacaaagaagagtaaacacatatcacagccatgttgttcttgtgtgagttttgaatggtagagaagagtgccttctattgagcatgtcgggtaggtttgctagattaggtaggaatttgtactgccctgttgagaggacaagctcctttggtaccaggaatgccttcaaagctttggttggtatttaggctgcttcttaagacatcctgtggaatctgtcatgtcatgtcctggacaagatgttcccttcactgtttcttcttgaaaatgtggtctacttaagtcttgagcaaagaacacttaatttcagtaagctatttttctttaaaagccatctcaacaccttcagtattgatgaaagaggaaaaatgactattgtgtttttgccctagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtcagtgacagtatttttgaatcaatggttataaatatttatgaaaatgaaagtctgttttcccataatccttttacgtatgcaagatgcaaacataccgtaattcatcagcactagaagaatacaaatttttcgttgtcttagtcattaattcattcaacaaatatttatggagggccatctctgtactgaggatacagtaaagaatgagacagtttcaccccataaagaatatgtaatacagtgtaggatagaagctagataataggtaaggaaaggctatagtttacagtaccatggtttagagggcaggtactgcagttacaatgtgaggactatgtgagatattaaataatacatacaaagaattttcaaaaaaatacatgcaaagaattttgtgcttttattgtttttaaagctacctcatgggtagattttgtattctacaacttaagagttgtgaatatgccaaccactgtgttaaaaaataaatcatctttcacattccacatctaggcctcatatttggcagtaagaagaaattaaattgtattaatgtctgtcaaactatttacccaacaacataacaatagaagtattattatttgctgtattaattatatggtcgggcatctgagaattccttaaactataattctataccccaccctcacccattctgtgccctgattctcttctttcagccccacaactttttctatgaacaaggtgctatacagtgaattaaattaagagctgggcatagggtaatggttaaaaaatgcaaactttggagccagactgcttgggttcaaatcctaattatgctgttagctagttgtgggacctggatcaaattacttagtttctctgtacttcatttttcccacccatgatatttgattataaattgtgtctatgtaacagggtgataaatatatgaagtcagacatttctaacattctgctttagtgatattttgtctgtaaatgtgattattattgaatgcatatctcttgtatttggtatgcaaacagtctctctaatagtcattatcttttaggaagtttatctggagatagaatcaagtaattaattactatttgttctggttgccagtctttccaatataactttattttatatagttataaattttctttaatgtattttaattctgaacctaacttcaattcaatagcaagataataacttcttattcttaatatctttcataaaggatgacatttcttatttaatagaatcttctaggtccacatagttccaaaatcagatggagacatcctattttacttttatgctaatgtatttaaagagcaaagaaattttatagaatgatgaaataaaatcaaaagatataatgttgaaatacaatctagatgtcattttacatgtttccatagaggcataggtttatgtgctgctatgacccacaaaatcccttgcttgttcccaaagactgaatataaaaaaaaaaaggagttttaaaaactaaagagagaatgttatcctgattttatagaaaactagtaggactgaatataatgagtttcctggagaatcattaataaatacctgtatatcttttctgcaacttactctagaaaaggctacatggatttgctcatgtatttgagaatcaacacctaaatgttagtatctgcttttatcacttttgacttggagtcatatttgaaattattttattctctctgtccatgtcatattgttatgtaattgcatgttctgtcgataaggagacacaaagtcttgtctttgtacctcagtttcagctcatccctcagggctggatgaattcccatccctctgatggatccccaggaaccagaaaagagaattttatatatcttacatacatattctttatatatcttatatacatattctataatttaggtcaagacacattgaatatcactctgaacttgatagaacttggctagtacttttcctgaaatacggcagtatacaattagacaggaatttaacctttttttaaaaaaacagagtagatcacaatgtatcggtaccaattctagtttgcagttctatttactatactagagcagaactacccaaatgatcaaagtgtgtcaaatagttgtagaggccaaaaagcttaccacttctcagcttagaaagatgaaagaaaagggcatatacctgtgacttaaaattgtaaactagtttgccaactatcagaaaattaaactaagatcattccttgaggttaaaatgaaaggacaaatcatccattgctgtgggcattagagtgcagcattatggaactcaacacaaagatggcttgggagaaatataacaaaataattacataataaagccataattttgtagtataattattaagaaacttcagcatggtttgagatacacattgctattttgaggatgtcaaggaagcctactctgccttcccataactcttttgatattgtactatcaaagataaggctattggttatgctactgcattgagtttgactctgaatacaagtcttatagtcttgtaatcttttttttttgagacagagcaccaccacacttggcaaatttttgtattttttatagagatagggttttgccatgctgcccaggctggtctcaaactcctggactcaagcgatctttccacctcaccctcccaaagtgctgggattacaaatgtgaaccaccatgcctggccaatatggacatattatttgggatgaatttggctacaagtaacagatgatgactcaaagatatcttaaacaaatatatttagttcccagattaactaattcagtgccttaatggtgttgtcagcagcccaggctcttctctttttatcctcaaggatttttttccctcagctttgtttgtacatggtcttaagttggctctagcaactctaagcatcacactagcaatgtccaggcttgccagggggaaagctcttgagtccagttttaacagcagtgagaactttctaaaaagccacccaaaatgttttcccttgtgtctttttgatcagaattatattctgtgtgctttcataactagtctgtgtcttggagaagatccagatagaaatacagagagacaagcactgaaagagcagcaaggatttatctttccgaacattgcccagcagtccctgacatatactagttcattggttgttttgtagagatggtgggagtgaggcaagtgggcgcaggagttcctactatattgctcaggctggtctctaaaacttctggcctcaagcgatcctcctgcctgaatctcctaaagtgcttgagttacagctgtgagtcaccacaccagcctgacatacagtaggttttaatagatattggttaagtaaataaatacacagtattgatctgatgatatcctccaataatgagatgtatttttgctatgtgtcaagttcatactttcaagtgccataccatatttttctagccatttttaataaaaattattttatttatttattttgagatggtgtctctctctgtcgcccaggctggagtgcagtggtgtgatctcggctcattgcaacttccgccttctgggctcaagcgagtctcctgcctcagcctcctgggtagctgggattacaggcaccgtgccgggataatttaaaaaattattttaaaatgtggcatattctttcttgccttcacttaggatagtttaacacaacactctccaatagagttttccaggttgatggggatattttacactgtctagtgtggtagccactagtcaccagtggtgactgagcccttgaaatatggcttatacaagtgcaaagatgaatttttaagtctatttcattttaattaatgaaaatttaaatttaaggctgggtgctgtgactcatgcctttaatctcagcactttgggaggccaggagttcgagaccagcctgggcaacatagcgagaccctgtctgtacaaaaagtaaaaaaaaaaaaaaaaaaattagccaaacatgatggcacatgctgtagacccagctactcaggtggctgagacaggaggattgcttgagctcaggagttcaaggctgcagtgagctatgaccatgccattgcactccagcctgggagactgagcaagaccctgtctcttaaaaaataataataataataatgaaaatttaaacttaaatacccacatgtgactagtggctattatattgaacagcgttaagttcaaccaccctgtttatctggaggctagtctcctggcaacctcaccactctagaataactcctttcccctaatacacagaacttttatactgtaaaatgcttcgtactgacttttgttcatactagaaatctttttttttttgagacggagtttcgctcttgttgcccaggctggagtgcaatggcacgatctcagttcattgtaacctccacctccagggttcaagcacttctcctgcctcagcctctcgagtagctgggattacaggtgcccgccaccatgcccggctaatattgtatttttggtagagacggggttttgtgcctttagcttattagtagcagtaaccaaaaggcattatgctgagaagagagttgcagaaacatgggaatcaatagtgataagcaacaaaaagtacaaaaagtgacaagcacagcagttaggttggtgcaaaagtaattgcagtttttgaaattaaaattaattaaaattgttgccaaaaccatcattatttttgcaccaatctaatacattaggtggtataataaaaaaaaaaaagcctaagctaaaaagctaatagtggatttaataatgaaataatgataatttggttttatttggatttatctgtagagaaggcagacagataaacaaataatttgtaaatattttaaggaaaatttcatgagaaaacgtactaatacttgtcttgtgaaagagtaaacttaagttatttggaaagtatctctcattcttaagtgatgccaaataatgaagatgtttataaacatatgtaatgtatatatgtaatttatgtacaaacatttcatatgtttatatgtatacaaactttcaaatattgtagagatagataagagaatctgtagtccagtatgataataaaagactttagctgttctttaccaattagatgttcttttagaaccgaatctctaatccacatagtggtaggaaaaaaaagaaaaggcaaattactcaattagctgcttgttttatctacatcattgccaagaaatctgttttttaaaaaaactgttcagagtatacctttaagtaatacctggaattgtgatactttattttttaaaatttttatttatttatctattttttttttgtttttgtttttggaggcagagtcttgctctgtcacccaggctggattgcagtggtgtgatcttggctcactgcaacctccgcctccaggattcaagcgattctcctgcctcagcctcccgggtagctgggactacaggtgcgtgccaccatgcccggctgattttttgtatttttagtagagacagggtttcaccgtgttagccaggatggtctcgatctcctgacctcgtgatctgcccaccttggcctcccaaagtgctgggattacaggcctgagccaccatgcccggctatactttattttttaaaaaatcattctatttatagttataacactttatgctttgtaatttgcatatttatattaaggaatttcaaccaaaaagtttctgcaattaaaaaaagatttctaagtttaaatagatgttaaatatagctatttaatttcagatgaaaaaataaaagataagtatttagtatatagtgtcttagaaacctgataattgaaataattgtttctttaaattttaggtattcaatatcctcacccaagccagatgagtttccctagactaggacccagcctgtttgaggttttatcaatattattctcccctacgtaaaaaacgcatctagataactatgatgcgttatagttataggctggtagaatctcacctatcttcctgccactggctttgaatcctgaactgccaccaggtgtcatgctagcattttaactgaagcctaatatacttaattaaatatttctaagctggtcaaatttagtatactaaatgtatatcatgaaacaggagtataatagagcattactaagttaaaggaaaaggctataagtaagctcttcttgtgcactagaaaaaagttgacttgtgtatgtctccttgctgagcactaattccttgcctcacattgtcatcctctaccacagtcaacttacagcagagcacatatttgtgatcatgtgccttaaaatgaaaaaaaccttgcaaggcttgctttaaagtcagtatattactcacacacacacacacacacacagacatacacatgcacacatacatgcacaggcatgcacattcacacactcaacttaagacttgaatttaagctggcttttatcatcctagggaattcaaagtatgcattacttgagttctgagcatcaactccagtagtatatagactacctaagtcaagatgcacaatatctagcatgactctgcagttcctgaagatacactctgtacttgtgtgggtgaattttgaagccagacccaggacctacacacctgttccagaacaccccatggaagccttcccaaaaaacggattgctctagatttcttggccaaatttctaggccaaaagccttgactaacgcaaagcttcccttgttgtggagagccttgtctaccttgttaaaatttaaaaatataactcaaatggtttctcaaaaagaagttatgagaaaatgagtaacaagaccccatgtggaccttttgcagatgcccagtccacttatgccaacatgcagtgtattctgaaagtttgttccacagcttcaaaagaaaacaaaatgttaaatgagtgcagtgcctcctgtttattaacgaggcattgatataactaaacgggtaaaaatgcaaagcacatggcaaagcagtatacatatgtcaattgctgttatgtttcagtaatccttagacaaaataaccctactgagaataagagtggggtaaaagcttaagtgaaaaagcaaataggttatcatatgcagcacatttaagtcttaaaaggcagaaaatatttttaaaacacatgtataccctgcctttaaaaatctaacattaaaagaaatttatatgaattgcaagataaaagatttgttggattagtgctaaggttctaactatccctttgaagtagtgtaaacaggtgaattcaaacaaactcaaagataataagaataattttcttcatacaacttagaaatgtagaagtttaagttaaaagtcattgtggagaaaatagcacactttcttcctggtttgggcatccagtattgcaaagttgcctttaaaattcataactaacactattgtaattacagaactatttctagtagataaaaaaggggtaattaccaaacctgagttttggtaggaccagtcaaaattttatgactgaaaaatcctattcacatgcctgaatattgggcttaactggtaagtgtaaagatcttacttgtcatggaaaatggagtagattacaattgccatgtcatcttttccagaggtactgggcagaggcaggtggcagacctgacatgcctagctgcccccaaagattcttgctatgatgctgttagaatcttcatggattattaaaccatatgtggacttttttgttcctacaggtctttgcttggctgttctttcccatatcttctgtgccaggtactccatgtttgcagctaaacttctgactcacatgatggcagccagcttaggtacacaggtaggagagcgctggcatttttgatttatcgtgagatgtttgtgtttcttcttctttggttcttgaactgagtgtaaaagtaaagtttaatctcaacttagttgaaataaacttgtttagttttgcagtggaagagaatggggacaggagagtcatataaggagaatcaggcctaaaatgcttctttctacagagaagcaccttaatatcatcgcttacaaaaaaaaaaacttcttatcacaaagcatcttattgtcagctaatatatgctgaatgtatttgtaatttatatatacattaaaattaacattttattaatctgtttgaaatatgctgtgttataaattctttatgtttagggcattaagatgatataaacttttaaagcatctggacactatgtattgtttcttataatagtttgatagaacattttcttttgaaaaatcagttttctatggtagaagaaactgtgtgaaaaacaatgacttattagcacacaatttaaagtatctagtttaaagcactgtgtaaagcacagaaaccagaacaaaagatgaaattagatgctttttctatccatacggtgttcatagtctagaaaagtagatgtacatataaataactaattcagtgtgatgtgtgaacatagaccatttgcaaactactctgtgaaaatagatgaaggcttaattcatttttttcatttttctctgaaggtcaagaaagtcttcatagaggagatgatattgagctgggactcaaatgagtgaaaattcagtttgttgttaaggactaaaaagggcctagacatttatataggcaaaggaaaaaaagcataatcacttctactttaaggctgaaattatagatccaggcagaaagaatattctatataatgctcttatggagataatttttaatattgttttataaaattaaaaaatcccacttttctggatggggagacacttctgcaatgcagacaatactctattgattgggtgctggtcatatgtgtgtattgaatttgtgtgtatttattgtgctgtagacatgatttgcacagttttttagaatgctaaagtgcatttattgaactctggatagaacttgaaaaaaatagcgtttgtggtggagctgaaatataaaatggaaaattatcttaaacattgggattctgtcacccttttttgttctaggagtgaaaatgactgtaaattccataactctgtttttcagggaataattaagtgctggattctaagcagaggtctctgattggttttttaaaggccctatgagctatgagaagtagcagtggttaccaaaggggcttgctttgaatttcacaaggctatttatattgcctttgtaacctgccttagctgtctgatctcgcctttgcttcttgaatctaagatcttagaaaacccgccttccataattagagtttacttggctttattcaccacccactctggtgattttttggcagcagaatttgtacaagacttaattatagcactatagaattacagacagctcttcagtgtcctagcagacaaatttgctcgtgtctagggatgtgaaagacaaaaccaggatttctatgttggagcactgacttttgattcatattgtacttaacattaattttggacaaaacggttagtcatatccatgtttttcagtatatttttagaatacatgaaacaatgtggcatgaaaaatcatgtagtgtatgacttgtgacatgaaataactaaaaaagtattttcatagctcttttttggcaggaagaattggtatgttattgatagaaaatagtttatttcaaaatgctttatctacttagatttaacaataccctctgagttaagaatagttatctcccttaaaaccttttagctaaggctttaaaaaattcttagaccccccaaaacaagaagctgactacagtaagttgggctcccaccctatctaaattttaaagtcatgtttatagctccagttatagaatcttgccaacaggagttattacagttccagccttggatctttcatttgggatcctctgtcaatgttatattgtcatttttggaggttaaatcaactctagagaagtcttaaaaaaatgcaggcttggcctgtggttctttagctaagagggaaaattctatagctgacctagagtgtttgagttgtgaatactttgcagacaagtctgccaagaccattcattttcaaatctttattaatgaactaggactaagtagaacggcttttgtggagaaggaaagaatggaaatgtggtagtcctggacttccttttggagcagtgtggtataatgggtccgtgaatcagaaagtcaggaaaatatgctcgtccagctctactttctacttctagaaatatgtagactattataactataatttattgtgtatgtgtatatgtgtgtgtgtgtgtgtgtgtgtgtgtgtattttcttgattggaggaatatagatacaaatccaaagattattcctgctttaaaaatcaagattctgcttgaatctggagtttgtcattatagcacccttgagaatcattgactataaaatatcagtaggtggcagtagaagatttatttttctcccttaaatttatcgatctctctttagccatgatggcgttcagtaaaaaacttgagagatgctttcatagtacttctttaactgggcaagagggtatttgcagcatagcaaatacacatttgtggtgtcctacctttctctttttatcctctttattcagaatttaattaaatgcaaatgtaccataagaaagattgtactccactggctttgaatatatctttctactgcttatatatgtttaaattcagggacataaaattagcttcatcattatatttatgagcattaagtgtgttattgatacagaaaaatgtttttattatgtcatagaagctttgagataaaggtctctattttcagtttatcaaaaaatgtacatatttcttcaataccaagttattttttctcacttatataaatgaaaatgattaaatgacaagaaattgtggggctcttcaagtatgatgtgaagaaacagcaaacaaattttcatggtattgggtgatatttctgagaaaaacatctaattatatctttgggatttttatctttgaatcacattgccaacccatgtgtgccctgataaggctggtaaacaactagtgacaaagagcaagtttgcagttcagggttctcagttctggaggttctgtcaggaaaagcaatcctccaaatctaaaaaaagaacagaagtttcctcatagaaaacatgatgaaaagatagaactgtatttactctgattaataatacttaacaagggaaaatatttgtttttcttctctatggtttgttatttgtacagcataaacacattttctgaaactaaatagcaaattcatctagaaatgtgtataagtccgtacattaaccgcaagactatagcttaggggtctattctctggaatttaaaaaagttggactgttactgtcttttgatcactttctcattctgcaacattttgggatgtcattttgcaatgtcctgtttcccagggaggatcctactcagacacccttgcgaaaagattctgctttaatctggaattatgtcattctcgctttgagtacctagcatctttgggaatctttgtgcatgactaaaggcagaagtcctgtgtgacttcccaaatgctggctccttctggatactatgaatcctggtttctgttccagcagcttgcgctgctttgttgagattgccaactcaagaaagtcattgtgtgagtaaggcttgaagacacatatgtaacaagcatattttaatcaactgaagcagagtaagatagagatggtaaaatgttcatcagtcagaaaagaattttccttagttggaagtttttgttaatcacttattaaccagaatatcctttgttatttctacttttttgctgaataaaaaagtatgtaagcgtttaagtacaaggatcaaaattaaatcttgctttgaagattaggaaattgagaagcagagggtcatttttcagtagaacatttatgattatatgttagtggagatataaatggatcaagaaagtagcaaggaaagtgtttcctaaacttcaatgcaggcatcttgttaaaattcaggtagtgcatcagtgagtctatggcgggtttccggatcctacttgttaagtaaggtattagattagctatattatgaccccaaaacatctctggttgttgttgttgttgctgccactgttgctgttattattattactaaatccatataatcaagctatttttcttagtatgaaattttatttaagaaatcccattaattaatttttttagtttcatttcaaatattattgcctttaaaacgactgcacacttgtatctttccctcattaatgaaaggctgctgctgtgtccttctgattttttttatttcttttttctaagaaagggaaaggtccttaggcaagtggactaagagataatttagagtatgaacaaggcctttattctggtcattctcatagcatttgacaatttgtaaaacttctcagtgttgttttggacataaaataaactactagaaagaagatataactagttcccctgccccaagttcattcttttctaccaagatcctgtaggtgccctccccccgctagaataatattgagtatgtaagcctttttttttttttttgtacaattaactgtatttaaatgtgtctttatgtagagattggggtatttaactgtatcttttcttcatgtagagattagttgggtgaatatgaataaagacattctgcacacagatatgaatatacatttaagttgaatttattaaactatttgactcaatttaggtatgctcaatggcatggtgaaaatattattacattcatgactgagtgaccattcaacattcaattgtgaaattaaaccaaaaaactgagccagacccgcatctcaggtcaagaccattattcatccagcagttcgaccacttccatctcatctatcatatgtacaatattaagattgcgcaatgagaaataccaagcaagatgcatacatgcacacaaagcgtgtaaataataacctaaagcactaacctcatagtaagaaccaagtatatacagagaaaaaaatctcttcctctgtagtactgcataggctgagaataagggaccccagtttgcaaagtctctgtggaggaaatggaatctgacctggttgttgaagaatgtataagatttgaagacttggaatgtgacacattctaggcaaggaaaagaacaagaacaaagacatctaagttatagtgatcctggctgctttcacttgagtaaggcttgcagatcccacagagaaataggtaagttttgactgcaggtgaggcagcttcccattgtctgagaaccatgaggagttacagagtcaccaatggagttagtccaaaaagtcacaatatgaaaggagtatttttaaggattgatctggcaatgaaggattaaaggaaaaatggactaaagaaggtaagagactctaattagggagagtagagaggttgggtggactgcttttaccatcatccgattaggatgggttctgagcttagacagtggtaatggcaatgagaattcaaaggaaggaataaggactaataaaaatatcttattttgccttattaaatttctgcacttttcttgtctgtctttaaatcaataaaaaagccacattgcaaattttatttactaaacattaatgtaatatttattacatattacaggaggtagagattatgaggtaggtactaatattattctcattttacagattaggaaattgtgacataaagagtttaattacttgccataggtcacatagtggtaagtaacagaactagtatttgaacacagcagccagcctccagtcatttttaaaactgctatactaagttgcttcataaatgaggaattaatgaaatttactctgtcaccaaatgagagagaagatttttaaggtgactgtgaaactagtggtttcatttgacttaaatatgaaagtggaaaggtttaataattggagaacgatatgtgcaattttgagcatgaggggtttaaggtttccatagcatggagatttagatgttatctacataaatgtacagcttcttgacactttaaaataggttctctgagacaggttgggtagagaacctgtgtatatagaatacatataactaatgtcattaagggctgggctttgtggcactgaatttagtgatttacacatattgcattatttactcttataacaaccagatgagatgggtactgttatcatccctaaagagactaagagatattcagttacctaccctaacttacataggtagaacattgaaggaagaagaatttgaagccagatgtgtctggctccaaaactcacgtatttagagaccacgctatgtggaatgagaaggatcactacaagaggattggaaaatgttaaagtttttgaagccaaagaaggaaaaaggtttcaaatggaaagatttgagcatcatgaggagattagtcctcaaatttggcaagaacaaggtccctggaaacttggagagaaatgatgaaaattagaaaaggttaaagagtaaatggataggaagaaaatggatgaggctaccagaccacacctgtgaagtttgtcaatgaaagaagaaggcaatcaaagcacaggaagtggggaacaattctggtggctctgatcataggtttgctgcagggaatctgggccctggggctgccacacaaggggcaggtctcccccatctcctccactaatattttctttccttgaaagagaacttcctgttgaagtttgttgaaagggtaataggaattagtaagtttctctttgatccatgtgtttatttatatgttgtgattaatttgaattttttaggtctaggcaagtgactccctgctaatgcacctaacttaatcaccttatatctaggagaaaattagagctgtagtttgagctttctttttgcatttcttgaatccaaatttctgtgatggccttatatttttggtattgttactattgaactttatgtaaacttgcaatcaatcatgaaacaaatttataattagcaattatcaaataattatataagtcattctacaaccaaaaatattaatattatgctattcacaagtgtgtgctttggaggattacaatgattttggtactcaaaatagagtgaaatttgcatattaaggtattgaattccccaaaaaaatattattttatttttgctttctttttatttaaggctacattttcctttatgtatcaaatttgtctttcttaaagtctcttaataataaaatcgaattccttttcctcaacaagctttcaaaattcagctcaaatagactgttctcactacattgaaaataagtggacactaaagatacaaaaatagtatcatggtcacaatactgggaaattcagactttcccaagtgctgaagtagcaaagcaacagaaagagtgagtaatattctgaatgaggctacagtgacattatcatgtttgcaacatagctttcgttactaggaaaatttgtgaggcaaatccagactttaccaaaaaataccagtttggaaccttttattacagcttcagtaacataaactatccttgacctttaaaagccttccttccttgatgtccctgactaggcaaaagcaacatatgaaaaaagttgtttttatgaatatttaatgagagctctaaagaactgtaacagatatggagcgtagggggaagtgtctcagttttggaattagagagactgatggggtaacatctgtcaactacagtggaaaaaaaatcactaggaaaataataagaatgcctgatttgcagcattgttgagaagatacatagtggatcatgttcaaatgcccaagacacaagatccgaggaaggagatttcagaagaggagggcaaggaggattcctgctacctcacgacatgcagaggcccttcaggttctgccctgagttgaacactgaatccttccagagaacctgagcccctgagcctgcttttctgtgcttcaggctttcttaaatcagctgcaagggaggggagaatttggggccccaccctttttcaataattggctctgtcaagcctgtaactgtgcctttccttgtactataggtaatgtagaccatgaaatttgtttccgttggtctgcattatctgtaatggacatcatcagtaattttgtttatagtttttaagagttttttttccctgatctgagtattttctaagtgtttgtgtcctcattgcttgtgttgaattgttataaccttaaaaattggatatatataatatgcttgcctatctagaaaattatacatatggtatgagcttgtgtgtgtgtgtgtgtgtgtgtgtgtgtgtgtgtgtgtgtgtacatttgaaatttgaaatagacttatattttgaaatacagagatacttggctccatagctgaagggctagagcactggtcttgtgaaaatacagagacacttatttaatgaaacagtactgctaaggacgatgataaacacttgataagttaattccagcactctatggcatagtcagtatatgtattattgcctctgcattgtgtgtaagaaatctgagacactaaacaattctgtgacttgccccaggtctcagatcaagtaagtctatctccaaagggtgtttccataaccccttctccacccctttacagaggagccctcagagaccccggtagtgcttcttccctccacttccttggagcctaatagcatggtcttcttgcagacagttttaacatttactctgttactatagtaagcatgctagaactaaagacttctctttagtttcctttgtaactctgtgaaatcttgcttccttctgtgaaactttttaatgagtggtccttacaaaattggtttttagatttacattgacctaaaccccaggaagttgtgtctcctgagctttatctgcttgctgtacagcagagtgccttttatgtagttgcctacctgcctggctgaactttaagctcccaagggaagaaactgttctttttcatatatcacatccaatgccaaaaggtaaaagaccaaaataacatcagtcacaaagacagggcagcctttcctataggctagttgtgtgcagtctagaactgcctttctggcagagccctattcagataccatctttcgggaacatacactctgtgttctgccaggatgggggaggagcttggtttcaggcactatgttttggttgtaagggcgaatgttattgccaaactgaaacatgtcaaatatcaacaaccaagtgggttttgtggtcacatttcatctgtagatgatggcatgtgcaagtgattttatggggtttgatgtggaaactatgagaaattccacaactccagagtgcacctctaagccccaaccccccgtttattctcgctcttctgcaagacagagatcaaggttgaatgaaaatcttgagtacaaattctcaatttttgcatttttaaaaacttttaaagtatagatttctttacaaaaaatgctcagagaaaaaaattaaaaagccaggcatggtggtgcacgctgtagtcccagctgctctggaggttgagaaaggagaattgcttgagcccaggagttggaggctgcagtgagctgtgatcacgccactgcactccagcctgggcaataaagaccttgtctcttaaaaaaagaaaggaaaaaaaaaaaccttagttaaccatatttgggaattaaatgcttttctactgtctgttttttgggtttatcccatttgtgatcccttctgtcaattgtcaccattatcttgctcacctaagccacctttcttcttttatggactccaaactcttccctgtggtcttaacctgacccctttctccatagtctgttctctcagcagcaggagtggtccttttaaagactaaattgactctaatcattttccctaaaactttttggtgtcttcctattgcacataacagagggactctgacctccatctccctcaggatcagtctctgcccattctctgatctcatcttctaccacctccccgttcacccagcacagccacagtgggcacagttctttaaatatgcccagcttcttcttgtcctacatcctgtgttctagttaatacctaagcctggaaagttctgccccagtgttttgctcatccgtatttccatttatacagcattgactcactcaactcttacgttaccacctcagagtggcctccgcaagaagacccacccctacggggtctcatcactgttatgtttattcatatcatatatccatatctaaattttcttgttcatgtattgtattctgtctccttttcccctttctaatggaatgtcaactccattagatcaggaattgcctgtcttgttcattgctgtttctagcactcataaaaagctttttggctcatactagattttcaatttaaaaaactggttaaggccgcgtgcggtggctcacacctgtaatcccagcactttgggaggctgagatgggcggatcacgaggtcaggagatcgagaccatcctggctaacatggtgaaaccccgtctctactaaaaatacaaattagctgggcgtggtggcatgcacctgtagtctcagcttctcgggaggctgaggcaggcgaatggcgtgaacccaggaggcggagcttgcagtgagtggagatcgcaccactgcactccagcccgggcgacagcaagactctgtctcaaaaaaaaacaaaaaacaaaaaacaacctggttaaataagaaaaacaatgaagttaaaagaaatcttaggctttcttataaagagcattcttggcaatctaaaactaacctatcaccattttctcatgaaaataagcacttcctatattctcaattccttaaagcaaaacaaaaccagaactgggtatggggcacatgcctgtaaccccagctactgggaaggctgaggctagaggatcccttgagtccaggagtttgagcctgcagtgagctatgattgtgaattatgatttcaccactgcactctagcctgggaaacagagcaagaccctgaatttaaagccagaattttaaagaagaaattattcatattcttaaatgtaatctgtagtgatctacatcttttataaacaaattgtattataattcttggtttataatttagatgtgttcaatgcagaattaattttcccagaaaagaaatgcttataaagagaagtcaagatctcaagccagccaccaaagcttatttgactcttaatctgtctgactgttctggatcctaattgaatttgtaacttctcttcgtgttaaaacattctgatttctaactgggaacttcaagaaagcccatactgctcccacagcctctgttatatggctcttcttccttcaaaagtccatagaagcagactacaaggaaaccaggtggtggtggggtcaggaaaggtgagatggaggggaagagggagacttctggaaactagcttcctgggtcaggtaggtgctctgcaaataagttggatagcaaatggtaagttttctgaaacttgtggtcacagagtgtgcaaagagaattggctcttcaagcagctttagtaacttattaagaagcaggtttggagatgagagaacaattattggagtacagaaaaagttttcctaagtaatgtctgtgttccaaaggaatgaaattttgtgttaaaatttagatactccaagatagataataactaattgtaaaagctaattttaatagtgttaactagtaaatgtctgtagtgccaaaataattaaaatgggccattaaaatatggctataaatatcaaggttattacattgttagtatgttgaaattgagaaatgaaataccccaacatactgcaggatgtctagacataatgagcaatcctgtcatgtttaggtcatgtttataattgtgattaatctactcttagtttctgagtttattgtatctgataccacactccaaaagccttttaacctatgagtagttgaaagcagtcattacaatgcctggtattttgtaaataaatggattaataagatataacaatcacaaatcctaatcctcctctcagaaatatttaaaaaaactaaaatctttgcatttaaggagcatggttttgtaccttggaaatctttaaattaaattgttggtttaacttttggaacacttttaaagtgttcaattaaatatttattttagaagggcaatataagcatttacaattatataaaaatatccatgtaggcactgctaacacagtttcttcacttcacaggaggacaaaggctgcaggcatctaagagattaaccccaggaagccagagtagctgaattgccagtgttttaccatttattgttaactcactagatactcgtgaaactccattaaaaaatgcccttgtattatacaaacaatccacacttgagcaacctttcactctaagattaggaattgctctttgacaacctttgtcagggttaattattgaagacttttgtgtgaattataggaaagtcagatgaggtcaagcaagtctgtctaccacctcctgtttgagtcttaaagtagcagaaaaatctattctccaggtaatgaaaagaagaccttttctgaaaattttgttgaagcacaatttaaatttatctcatgtttgcagttattcattcattgctcccgttctccaactatttagtgtcatatgtactatgacgcagtaatgtcatgttatgtaaaatatagtaatgacatagtgaaagacatagtttagaccctccagtaattttctgtctaccaggagggtaataaagaagtaaatagatgaatacagtagaatggtgtaagcatataatagcagtctgtacagcatatagtgggaaccaaaaaagagttattaattctatccaggttgaggagtggagtcaggaaaatcttatagcaataaaaatgcttagctgtcttgaaagatgagatgtcttcaccaggaagaatctacatataattaaaagacagacattagtaaaggcagaggaatgggcagtatctggcaggattagtgacgcaaaaaggattgctctaccttggattatgttctgtttagtttgcaaggaatctgggttggttcaactggttaagagctgatggtgaggaaaggagagctactcctgggcagacctgttggaaaagtagaatagtcgccagacctgagcagaactgatgtatggaggagcaacagaaaatgagaattttttggaaagaatttgggttccacagatacattttagtgtctcacaagcatttttttggaaatgtgttaacttgtctaatctgaaaaggctgaagtatctagttctgtactactgcgtatggagaaatggaaagtttctgtctgttaggcatcagtagggtttcagtgtgtggtttttttttttttcatttaatgtctcttacaaatttcatattttaaagaataattcctcataacatcctccagtgaaccctttgtgattagtttaagtgaagagataggaaaaaatagttaggtgtaaggtatattttttcaatgctttttcttttttttaatgttatttcaaacacaatttactgctatcacatattaaagactcacaagacataaatcaatacaactttaccttttgaaatatttaaatttatataaaaatattaacattacctcttacatgccctttcgtgaaattcagaaaaaaaaatgaaactattaaaactgcagctgcatgactatggaaaataaatcgtgtgtatagtttctgtgatattaccctttgtgaatttgctattgaattcatattcttgaggtaaagatagagttcagaccttagaaaaatacagtgataatgccacaggaaaatatttgtggtgttgtttaagattcagcgtgtgtaactcttttctaggttattaataggcttgggaaaaacaatataagcaatttctcctaaatagaagcaagtttgagagaatagacttccgtcagaattggctactgttagggagaaaggaagctgaattcaaacagttttgtgagaaactggaaaagaggaagcaattgagcttcacaatcggtcactgatatttgatttactttctttggagtttacaagtggctgccaagttatgtctaacgcacactgcctaatccttggaggcctctcttccagctgatgtctgcgtcagtggtggccatgagagaggaagcaacttgaagaaaagattgtttaccacttaaatttaacatggaattcgaaggctaacgttaagtggtttagaacaccactagaatgctgttttgtatgtttgtgattcccgaaacagtcacccagcatctagtcctaaatatgaattaagatctcattccgaagaacaccttcttatcacttctttgaaggtaattatgaaaagtcaaagatgtacttctaaaaaatgcctctatgttcacagtcatttatgagattaaacagataaccagctgactaacaaactccaacatagtcatgatggtgtccttaagcagattataatctcaggagtgctggggagatttatacagatatgaaaggagggcaaatcaaggaggtatgaagtcagctacatggtgtagtgtaggtgtcacacattatttgttgttgcactttacactttccccacttacaggttacaatttgcttgaagattaaaaactcgaaccatatttggttgttaattctccttctgtggacagactggaacaaatggcaagagaaacgattgcccagctacatgtgagtcattctttcctgggataaggctacttcagctttaagtggagagtggcttggggaagctgttgtggaagtaaggtcacagggtttgagacatgtttgaagcaaggcttttgttccagttcttccagtctgcatgcaaaaggaaggaaggagaacatctactagcaaaagctgaatgaggacttcaacctcacctccatggttccccacacaggagcagagcccagccaaggttcccacctaacaccatctttccagaaattgttttgagatacataggagagaaaggcccttatattcacaagaaaacccagcaatcatattcatttgaaaagcaatccatatgcacattttggaaacaaaagaagtatcagtacacagggtgaaataaacttgaaaggagatttgtaaagaaaagaacaagcagtattcattcaaaaaaacagaaggtaggatgttatggaagtaaaacagttattttgtttaggtttaaatttttttaacttttaaaatttgtgatataattttgattatgggaatcatagattcctgttatcaaaggaagaatgaccttttcccatttccttttgagtttcttaaaatttcaattttctccttaattatactattttatgctttttttttctccaaatggtaaggcgtatgtttaatttaaaattttaatttaaattattttggccaggcacaatggcttgtgcctgtaatcccgacactttgggaggtcaaggcaggcaaatcgcttgaggtcaggaatttgtgaccagcctggccaacatggtgaaacccctgtgtctactgaaaatacaaaattagctgggtatggtggtgcacgcctgtaatcccagctacttgggaggctgaggcaggagaatcaatcgcttgaacctaggaggcagaggttgctgtgagctgagattgtgccactgcactccagtctgggtgacagagcgaaactctgtctcaaaataacaataataataataattaataattattttaagaagcaatttttagatttctatttttttccttttatttacttaattccagagaagtaatggtattattaataatattcttcttgagctcctgttatattccagagacttcaggtatgctactttattttattctcacaatagtgctatcagtagacattgccatcctcattttatactaaataaacttaaatctgctcatgatcccatagctatgaagcagggctaagatttgaacctatgtgtgtctgattctcttttaaccactaaattacaaacacaggtgtataaaaaatgtgtgtataaatatgtatatcatacatacatgaatgtatgtcatgtacagtatctgctgtttccttttcctgaaaattgctaaaggctttaatcagatagatggaatttgaacaatcagaggtggagcttgcctctcagtggggagaaagcattttgagcaaagaaaacatcagtgacacacattgggtttaagaaagtacaggacatgttttaaaatacaccaaagtaggacattgactgacatgtactatatctttgaatgagagtgttgtgggttagcttgaaaagcagattcagatcagcctatgggaggtcatgaaagcttagtttagtagttgggactttactttccagtttttgatgatttttatcaagaaatgatataagaagatttatcctggagccacctctcagctcagcttctctgaacattgtggaattattatactaacgtgcacaaacttgtaacaatagcagcaaccattccaatatgtcagctttctggagaatattgtccgtatgtcaggatatgtaaataatttcaaatttctcacccttagtagtctcccacccatataaataagcttacagtgaatagtggccagattttagcagtgagttttcctatgtagtccattcctaatcaaagactgcattacaggattcatggttctgtctggtatacttagtattgtaacatcctctgctttcactctttggggaagcttaacctctgtctgctcaatgatgtattcttttcttcatacctggataatgttttggagtacattttaataaaaccagatcatgagggtaaacaccaatgtgagaagcttcattgtgcatctcatctttagttgataattgatggaatattttgtatttcatggatcctacctcagtacatggccaagaaactgctggactccacctgtgcaatttttgaaaagaaattgaatgatgcgttccaggaagggtttgcatttgctcattatttctggcttaatcaaattaaaggagaagaatgaaaaacagctaactccagagcacctgtaaccagtgttgccggaaattatgaccctgttagcttgacattgtgtggtgaaggggtctaattattggactgttaataatattatttaagccctcattaaatgtgctaccatttaataggattttctgatcacaaatcttcattagagtcttagaaagtttttttttaatcttgtatttttccataaattcatcccattgaataactcaagggaggtgaactttggccagtgggtcacagcaaaggataaagattgggtgatgtatatcagggatgggcggaatttgtaatagtttccagctgtctcagcagtattaatgaaagtattagaaaataaatatggaaaaatgattagagattcgaaagaagagacatcaagtatgcaatgtgggactttaaaaaaaaaatacaagatcttgctctattggtcaggctggagtgcagtggtatgatcatagattattgcagcctcaaattcctgggcagtcaagcgatcctcctgcctcagcttcctgagtagttgggactataggctcaacttttttctttttttgtggagatatgtcttgctttgttgctcaagctggtctccacctcctggattcaagcaaactgccggcttcagcctcccaaagtgttggggattacaggtgtaagccactgcacccagcctgcttttcaacttttgaaaacaaaccaacatttataccaaggactgagccagaagaaaaacttctaaatttcatatatggtagaaaattgcagatttcctcacagatgtaaagagattacctttcatattaatatactcaccttcaaacagaaagttatctatagattttagattgaagttgatattttgctatactataattattttaaaagacagactttttgcctttctgaaagtagttttcacaaaccttttcagtacttctttttgtatctttctcattaattttgaaagagaagaaaggaaatattgaatattctgttgagaaaggaaatattgaatatcgtcttaagacccatgtcttttacctttttaattcctatttcctgatgtggagagaaacttgctcacagtctcctgtactgatggagctgtaaatctaacatacatccagatcatttcaaagcctattttttctcactacacagatgcctatatatttcttcattacagccttttaaatacttttctctgtgataattcccactttaaaatttcgagaaagctattgttctggatggggaaactccctttgtgccctgcagggcctttgggtacactcacccccttcctgcttaaccagaataaagtgctgagtttgcatttcaaatctagaaaataaataccttttctttttctaaaggaactagggcatatggattaaggtaaaggaagatgagaaacaacatccaaaaatacacattttttaaaaaatagtcaactaataagttcatgttttataaaaatataagtaataaattatttttaacatgaacgtaattgtgatttcaaaatttcaaaattatagcaatgtccttaaaatagtgttgaatttaaaatcttcactttacaaaatgtctgtgaccatattatctattatgctgttagtaactagagatttttaagtaaagatagcttttttgggtagtaatattttcatcaaaattgcagtgcagtaagaaaaaaaattcagtctctaccttgaaagtttagggttggaacataatcttagtgagtatatctataaaactgttagcctcaattatctctgaattgattttgtttgttcaaagacacaactgtgaagaatcattattctttctactgtgttttcagatgaaccctgacagatctttcatgacagataatactaaaaattacatgttcatctgtgggaaccagaaggaaggtcatatcttgcttctacctcctagaatagctccatggtatttcaggccatcgaagaggatttttatgctggagaggcagcaaatatgtattgatccttaaataacaatctaatttcttctttcttcctattactttagtaggtataaaatccagtagtgaggtatgccgaaaatggggtggtctttagactcctggttagtactttgaacattttcattttaaataatgattctcttgcaaactggtcattcctgtgatacatatttccctttcacagcttctgaatataacttggagtgatactggtacaatgctgcctttctctcccaccttccaaatgtatttgcatatgtgcagactattcctccttctaactgctacttctctgttttttgcttcttcggcctttcaccttctcacacccccatttcctaactccccaaggccatcattctcaccctgcattttgtagctagcagatatgtccatgtgcatatcatcctttcacttacgggactgtggcatggagaagtgagttgcagtaactagacctctgcattcctgagtggaatgttacagggcctctgcaggagttgatgggagtgggccccagtgagctggaaggttgtagtttgacagtcgagttctcttctcctccttgcatgtagcccttagtttgtgcatcatccatagcattccttattcctcattacttccctccttgtctctctctattgccctgtgtcaagttaggaatcacattcatagaactaaattactatcatgcacattaacattactggcattaaccaaatggtttttataaaggatttatggccttagactaggatttctcaactcagacactgttgacatttgggaccagataatttgttgtggggcactgtcctgtgtattgtaggatgtttagcggcatccctgctctctaccattcaaatgccagtagcacacttcccctaaaacattttgcaaaaactaaaaatgtctctagacattaccaaacgtcccctggaagccacaatcacctccaaatgagtaccactactctaaacaaccaatctattcttttcatcatttttttctgcacattttatgaaatgtatcttgtttttaaattacagaaccgttacctcctttgactttaggatgctggttttaacacaactgggtcattaaattgcttctgacttgtttcatattatggtctcttcaagagctgctacatttttacagtattgtttttgtgtgagatattgaaaagacaatgttagtggtatgtatcaggtgcctatgacaattaattgcctgatcactctaactattctttggagactgtcttggtgattactctgccctcttccttatgtgctttgtgactcgaaccaaactactagtttcaactttttgtaaaaactagaccccacattgttgttatgttttgtttctccagcccaaagcatagcacaataatcgtcttgatttaaggtgaccagttatctccacctgcctaggactgtcctgggtttagcactgaaagttctacatctcagtaaatccttcagtcccaagcaatccaggacagttgaataccctaactgataatttccttttatttctttggcaatcaaagtaatgaatcctactctcattcctgtacaatggcctggggagtttagtacaggggcactgaggtcctgtgggttgagtttggcccacaatcgtggtatgtatgttcttacagtatgcttcccatggaccatgcagccccacattgttttatatctagctcctctacacatgtatgttaatagttttgtgcctgataacctttgctttgcaacccttcatttaaggaccacttccagttttatttggtgaagaaaatctttagctctctgtagatttttcacaagacagactcatagatgtacttgttgttcaagatgtttttctgctaccacataacaagaaatcagctttctgaagcaattaataatctcttggcagtctttctaaaggttttcttgttcccaggtgattaactcaaagacttcttaaagtctcaggactttatagatgaaacagatagcaatctgttggatgatgactaaggattgttaaattatcttctccatacttacatcttctccataatgatatggaaatattccaactttagcttaactccttcaaattaaagtttgtctctacaaaacctccagttaaagtgaaaatctgtgggaaataacaaacccatcagcatatagtaagtttatggatcaaatggttattacacaaccctaggtgaaatgtgataagctttgagaggagatggaaggaagcattctgaagcttaatttgtctggcacaaggtgaggactgaaaggtgacagttctaagcagttaaaatactgtggagataaggagtgccaggagaggggttggaaacaggatattggttagaggaagagatagaaatgaatctgccccataatttgtctggcccttttattcttagcctattgttttaaggagttgcttaatactcgggtcttgaggctactgcatgtaacatgaagaagaaagggaaggagggagagagggagggaggaagaaaggaagggagggaaggagggtggtgatgttgctcattacccactcccagtatatggaagtggctggatcaagatctcattaactttaaaatatcgaatactaatcccgtgatgtcctcccctgattttagtgtagcaggattaatagttgtacttagaaggcaccaatgatcctgttgctgacataatccatattttttgagcagcatcaagagcttgcagcaacctatcgttctggaggctggctattggcactattttataggaaattgctcaaaggaactctgatcatattctcactagtattacctaatagtcgggaacctttattttccttctgaagatggttcaaaaaattatatagatcacccactcctggttggtctttggcttcagcttctcagactcttcctctcctggccaactaccaactgctagaggttgtcagctcactagtgggctcacttattttctgtctctatagcagtatttaacaaagtactgggatgagacatgcctggagagtttaataaaaatgcagattcaaagcctccaccccaaacatactgaatcagaatctcctcaggaattgtatactaaaattatagaaatattactccatactctctcgataaatgatctcatcattagccatagcgttaagctttaaccatttttgtatacttcgtgactcacaaacttttatctccaccgtaaaccactcttttaagctctggtcttatatactctgttgctccttgatagctcttcttggatgtctcacaggtatctcaaatttaacatgtccagatgacaagtttaacatccgcttgaaaaccattcttcccagtttcccatatcttaataattggggccatcattcacagagtttctcaagcattattctttccttgctataagtgtattcagcttaccagcaagacttttgtgtgccagcaaattcttttaattctacctttaaatgatgccatgagttcatctccttttttccgaatccatctactaccttttgccaaatgtaccacgtcttatgtgacaactgaaatagtcttttaactgatctgcctgcttcacctcttctctcaaccagtttgctctctagttaggagccagtgtcatcttttaaagatgtcatgcgtgtcctctattgatacccttttacagctttccactgctcttcaagatcaattccacatcataatatggctgttaagactgtatcaccagctccggtccatatcaccaatctaccacccacaccacacggaccttgccttcattccctgaagctgtcgtgccttggaacctttgtgggtgccgtggtctctgcctggcatgctcttttcactgatccttggctgtttgtatcagaggttccttctctcacttcaaggatcaggttaaatgtcgccttttatggagggcttcatcactctatttcactctatttaatcctcccatctctccaacagactgtattctctcagttcattttcctgttctctatagtactcagcatgttgtggttcttgacttattcatctctgttttctcatggatgatacactccatgagggcaaaaaccatggctgttttcatcactgctgtgcactcattttctgctgcagtgcctgatgaatgataagcactgaatgcatatttgttattacttattaaagttttatttgtttgtctttaatacaaggccaagaatgtcttcagtgtagggccaagaagtgtttatatgggaaacaatttgggtgagattttataataaaaaataacaaatttgatagcgaaagtgtaaacctaaaaactaaaacctaacatggagttgtaatagttcaactctaccttgtccctcctctctcatgctgttatgcagattatatgtcaatctttgataacatttactagccaatgcttcctttagctgtataattcacaatagcatttttgtaccacagtttttttaagtcaggattctagacacagtaactaattttttttcttttatgtggaaaaagaacacagggttgatctcagatacacagataaagtaggcatttccctacagagtctaactctagggagattataaaagcaaataaaatgaaaagtattctttaattcctgtttttgttgtgtgtcccaaatttcaccattttgaatattgtcctgttctgttaaaatcatatatgcttgaaaatgtcattacagtatcaaactacaatgtgtatgagatctgtcatgtcacatttatgttgactagtggaacagagtagcattaaataatgttttccctctagaaggaagagtgagctaaagtgaaaactgactaccatataactctgtgatagcataatttcatttttaagcagaaatatttatgtagatttctgcctcattactgcactgtgagttcttaaagagaaaaagtttttttttgtttttgcatttgcatcattaggacataaaatcataggtgttcataaaattgtattaaaaattggtaactaaaatataaaatagcaatatcttctggctggcaaaagtgcttaaaaacaaaataatacattcttggcaaaagttggaatgatacattcaaacatataaatgtgcttgtggactttgcaggaaaaaatgactaatgggccttcatactttacaaatggataatgtatttgatgttggatatcatatatcatttggtgtttttatcattgtactgcagatttgcttagtcaactttatattagttgcctttgttttctcctttcttatctagccattttcaccttctatgcttggcttattcaggttcagtggtacaaatattgagtaacaactgttgatgttggcatacttttcacaacccctctgtggcctttctcctcattaccttatctgacactcctttcactgtatttttactattcctgcaaaacagactctagtgaaatataggagccatagtgtaatcctctgtctactatttttctcatagtagaaactgtggctacatctgggatatcattagcaagctaaatgctgactatcaaatcttggattgtggccttctatgagtcatttgtctgttgaataaggtgtgtacaatgttggaaagaaatcatagcaaggtctacactggagtgccaacaagtttttcaaaaagagttaccacacccaaacaagcattttttcaagagctaacattaagagtaattaacatttaatatacccccacttgtttgtccattaagtattcttgaaaactaacattttagccatgtgcgtcagtgctcagtttagccccttgatcttttaagtgtttgtctttattaggtttgtcttctctgaaaagagacctttttaaatattaattgcttttcatacaaagtgaacctactctgtggaggttgatggtttagttgaattaacatcagcattgtggtctcttaacaggcctctcctcattatagagaagacttattcagggaatgaggaagagctcagggctcttccttgtacagaccattgttttcactactagaatatccccttaagtatatattcttaaacagggtattaatacatttttgttgatagtctgttacagtaagagggaaacttctggtgaatctttcatctacaacaatataaaaactatgcaattttattttttcctcattttttcaccttttttggtcagataaaaatagccagatttttaaattattatataattttccatgaaatttttttgtgcataatttgttatcaatactcttccatgtacttgagaataccatatttaatgtatatcaagttaaatgatgttgtgataccatttgttaatgtttcatatgaggataattgtcctaagtcaaacagataagccctatcaaaagtgtgtactgacacatttgataggaagcctgtggagaaagagagggctgatggagactgagtttctttcttgcacataaatagttattctcttacttgagagactttgcacacttgttctatacagctgcaaaacctttgcccattccagctgctcactcctaaacccagtctggttgatcagtcttgcagctcattatattgatacactattttaggtgtgatcaatccttaaccccaaggagggaaaaaaggaatccctttctttgtttgattccatatttttaaatatagtctaagattgctttagctattttagctattgaaaataaatcataagggtgactttagttattacacagtgtgaatctttttgcaactcaccttttcataccatgttaggtttctgaaatgtacactagctgtgtgtaggtctgttttatgcatttgaaaggctattctgccctgtataaaggtcctattgtgtgttcattccttcctgtctggatgaactctgaatggtttccacccttttgctcttacacatggtgtttcagtgagcaatacagcacagcggttaacaacattgactccagagctggattgcttgggtttgtagttctaccactgctagttacaggaccttgacaagtcataaaacccagtgctcagttcacccacctgttaaatgaagcatatttcctatgaggtaggcatattatgaagatagcagagtaaaaacacatgaaagacttaaacagtacctgtcacataagaaacactatacaagtgttccatttattaacatgacccttttacacgcctccttacatataaatgtgacacattttcatgtgtaaatgtctagaagggtaatttctgggccacagcataaggatatattcagtttggcccccaaattgttaaattgttctctaaagacattgtaacaacttatatttctatcagtgccatgtaaattactgtttatcctcatcttcttcaacacttcgtgtcatcagatttttttactattttttatctgctgattttaattagcattccctgataaagagtaaagttgaaaatctttttaaattggcatttcttggagttttcaattaatatactttgtacaaaacaaaatgtatgacagtggatatgagcatatgaaattaaaaggaaattcactttttacctctaggaagaaggagcaggaatggaatgggagagcgggtttatatgcatctgtaacattttttttctttaaacaaaaaagtttgaaaaaatatggaaaatttttattgttttaatttggatgatgagtagctgtttatattttatattataatatatattatttatatatattatataaaagccagcatttagacttccttttgattagacatacttttgtatttctcactctttgtgtgtgtgttggagttagcaatagatgtgtgtattggggtaatgatgttataggggtgttagacaacacaaactgaaaggtaatatcgaaatagcttttaagaaaatatcaccttcctatagatgactgataagtgatagctatattctaaatataattaagaaaattagtatgtgcagggaagcaaattacttacggtaaaactttaattataaaagtataaatgggaaaatgaaaataatatctaacatgaaaaatatatttggagcataataggagcaaaaaggagaaactttttcaggtactgataatcatctcatcaattatggtgtgatgataaaacaataaaatatcctatagaatatcatatttaaaatgttttactacaaaattaattagatcaataaaattttacttggctatagcataaaaagttcctttcttttcacttttagaagaatttctgttttagataatatcattaaaataggtgaaatgttattgacaatgaagggaagcaaatgtcataaacccgcctgctatcattgcttatccatgtaaatatgtaatatttaatttggggaagcagtaatatatttgtaattattaatgtagttaatatggaaactttggttctaacatggacaaattatatatggtataacctcatctaggtaatttttctttagtctctattgaaaagttatgagttcagagtagaaaatgcactttaagtttcatcctttagaatgtaaagactaaaggatggattcttttgaaaaaattgactagaactcttgattctagtttcaaggggaagtgtcatagaatctttcatggaactaaaaaatcattagtgtagatttatccacttcttttgctttgaagtgctcacctctctcaatgttgcaaaatttcatgtgaatgtgaggtcacctttccatcatatttcttaacatgtttcatataataaacttttattatcttgagaaattttcaaatttgttctgttctagtactttctgattcaaattgtccaacacagtgttataataatttatgagactgtttcattgatatgaagatagaataatatgtgataaaagtatggttttcttaatttcccagatcccaaagaacaaagtcttatgtcattcaggcctggcaatttgaaaatcataaccatttgaaaattaggtcagttatggatccattaatcaaatacatttaaaaaaactttagtgaagtaaattggaaaaacaaagatactcatttaaagtgtacaatttgataagttttgacatatatgtatatatacataccattaaaaatcatcagcacaatcaaggtaatgaggataccccaaaagttttctcttaccccttttaatccttcacccccactcttctatctccagttagccagtggtctgttttctgttacaaaatatgagtttgtatattcttgaattatatatttttgttaatgaagcatattcattataccgcaaaagagaattccaatccagtttgtaatagagtgatatactaattctaaatgatttttctatattcattcatgtccttgggaagtgtccaaaacacagcttatttctatccataatctttaatcaaaacttacccaattgactttggctctggccaagatggagtaacaggggtagatgagttgcaagcagatttgtctattagttatctattgctgtatgacaaattataccaaaacttggcagcttaaacaacaatcatttattatgtcacaaaatttctgacggttgggtatctaagagtggctttgctagggagttttggcttctgctgttcatgaggttgctctcactatcagtgaggaatgaagttaaatgcttgactgagggtagatagtctgtttccaagatgactgactagtgtgacgattggctagaggctccagttccttgctttaggaaggctttggattctcaccttttgggctttttataagactgttaatgatagtatcagcttcccccaaattgaatactatgaaagagagaatgagcatgaccaaggtaaaagccacattttatttgacagtctactcttagaagtcatgtgccatctcttctcccatattttactggtcgcacacaactaccctagtctactgtgggaggggactacgcaagagtatatcaggaggtggggatcactggggccgttgtgaaggctggctgccgtgatatgtttggctatataaagtcaaactattcgacaagttttaagactcttgtgtaatcagcccataaaatctattttagcagtatccatttgcttataatttatgagctgactacacaatagttttacagttttatcgaataataacttttaaagcatgtatgtatttaataattttggaacaaaagagaaccatctttataggttaaaccttcagtgtgttgtaaaagaatctgaatcttatttactcataaggattacttgtaaggactaataataaacattaaagattagctaattcaatatttattttttccatgccctgcagtgacaaaaggttgttcattttggagattattaatatgttgttcacactgttcaatgtatttccaatattttaggtgtaaatgtatcttaacaattaatgttgctttaaaaactggtattgggaaacataaagaggatatcattaaatctcacattagcatactttcagaaggtcatctaaagctgaattatagcttgtggctaaaccctaataaagactcaaaatattaatggatgttctcatatattaatggtaagagagtatgtgactcaaaataagcccccaaatgcaaacaataaaaactaaattgaacacagcatcaaaaaatctgtcagtaaaatcattgtgccccaccctatggcacatgctattcccaaggcagagcagcaagctccaaagcttaagttttggcaaaggttttcatcattctcaaacctttttccagctccaagatctgtgttcattttcattattatttttatgcccatatcccactgcctcattctctgctgttacttatcactttatgacattaggattacctgcagaattggatgtaattttaactgcacccaaaaccagagcagcatataaaatgagtaggtgaaatagcttgcctttgcttagtgagttgtggggatggccggctgtggggtgggaaggactgtgtatgtctgctagctgacaaaactgagcagattaacaaattttgactattctgctcccatgacaacactttatttagcgatatttcagtaccttgttaaaaccacagcagtcaccgactctgcaaggcagcacagtgacttcccagactccagtgagttccctgagtttgacagacacagattcactcaagcacgaacacaagaaatcgcagagtgcaagacaatgggtatctatttctaagaatgaatatggaacctgtttcatttttcaccttcaacttcttcaaggtgatttttgattaaatgaggaatgtccatattaagaagcaatgtcttgtttcctaagtctggtccttaagtcaaagtgctctaattagatcaattttagccattcattacattaatcagtatttattaagtttctcttttctttcttttttgtttttttcagacagggtcttgctctgtcacctaggccagagtgcagtggcatgatcacggctcattgtagcctcgactttctgagctcaagcagtcctcccacctcagcctactgagcagctgtgaccacaagcatgcaccaccatgtctggctaattttttttattttttatttttgtagagatgaggtcttgctgtaatgcccaggttggtcttctgggctcaagtgatcctcatgccttactgagtttctaatatgggccaggtaaccatgttcacagtggtaaacaaaaaaggacacagtctctgctctctgaaagtaaataccttggcatttgagacagaatgaaggggtacataaacacactttagctagtggtaagtgtaacagtgaaaatcagagagtaattgaagggatgtggggtcagaaaaagcatcactgtggggctgacatgtgaattgagaagaaaggaaaatatctaagacaataacagtcttgacagagaaaacaacaggtgcaaaggcccagaggcctgaaaaagcttggcatgcttgagcaacaaagtggacattgtagctggaattttaacaagatggggagtcttagaaaatggtgtcaagaggtgggtagggtcttcacatagcacatctttaaaacttcacctttcttttctctttttctcagttaaataactacatagaatatctgtcgccttttcagcaaatttcaagatagaacactgaggagaatgccattattttggctacttaagagttgaaatagcttctaatttgctggtaatagttttaacttgctgtcctccagtttgggagatacagtgtaacagggagcatacagccaaaatctgagacatctgtaagcaagcagtcaggagtagcttgactatacatccaaaagtatagtcttcataactttgctttgtgaactgcttctgttaattttttatgaacagttggcctgaaagttgtttatttataaatgtgtcatttattagaataagatgtgctctattctgtttaggagggccaatgggggtgcagataagtgcttgaattccattctcggaggtcattgactatcaaaatgatcaagctaactggatttcactgtagttgaaaatataaattgttggattgtgtcattgttaaactgtgataaattaatttaaatgcaatagatctgaagtttcttcctcagaaatttcagtttaaggaaatttatctctttatgtttgttggtcttacaaatttattctgaaataatcagattttaaaataaataaatctgatattacggtgaccagtggtttttttttttttttttttttgagacagagtcttgctctgtctctggggctggagtgcagtggcgtgattgcagcttactgtggcctcaacctcccggctcgagagactcctcccacctcagcctcccaagtaggtgggactacaggcattttccaccatgcccagctaatttatttttgtattatttgtagagatagggttttgccatgttgcccaggctggtctcgaaatcctgggctcaagggattgacccccctcagcctcccaaagtgctggaactataggtgtgagccactgcacctggctgatttgttatgtattatgtaagaattgaagttatttcttgagaaataaatagataacaatttgcactttaataggtaatgtatcaggcaagttgacacccattcatctggtttggcccctgacagctatgctttattatatggtttaaatagatttgcattagaagtgaaactactgtaagaaaataaatatctcatgtaaatgaaaaagtaaatactatgatctctcatgaaaaagactataaaaatgtagccttatcatgaactccttgtgcctgcaccagcacaagacagcattaattgggcaagaaggggcctatcaggctggatgacattccccttatggcaggttcttgttggggggctgacccacagagtgtagaccatgaagtcccacaaagcaatgacctgtatggacaggttaggaaatttgaatccttgctttagggagtgaagtgattctttcacatgtatttgcttctgaaatagctatttcttattggctccttattgtttgttgtttgcacacattttaaagaggaaaatgtctcaccttagagaaacagaattgaatacaaaacatcactgagctagcacaaagtttagcacattgaatatatacttacatataaatataaatattatgtaaagttttagttttatagatttagttcaaataaaaataaactgttgacagaaaggcaggataatgattcatagttaatatttaaatgattcaacattgaattcaacaggtctagattttttacccttacctgctgcttgttaattttgtccttgtttcaccagctataaaatttgaataatatagtgttaattatttagaagagtaatgtgtggatgtagatatatgtgtgtaatacacatatattgtagaattaaatttattatataaggggtccttgaagtactgcaagcattagcacagtgcttagcactcaacaaatacgaatatcattgataatcatattttctcctttttgtgcccccaaggtactctttggacaaagtactcttggacattttgtattctactattgtaatatcattcaggactaaatcaactctaaaataagtttttacatctatttggaaacctagatcttcctttttgagggctatcgttttgcctaggaggccttctttggcttgggttagctatgattaagagggcaagaaaatgtttcccttctgccgtgcctttagagtatgtgtgggtgggaacaatgtgctcatgtaacctaacagcataggagagggaattgcagatttggtgaacttgccaaaccccataacagtagcagatggatgaggtttagagggtgttgtgccctgtcaccagaccctgctgactttagcctggcttttccaaatttcagagtctttgcctttatccagttccctccaggcccaggaggatcttaaaagtaagatagaggttttctaatgaacaagattgcttgatgtgtcccctaagaagcactcttcttttggctaggcatgtgtagtattactttggaaagtgtttgtttcattcccatggcacatttatatgtattaatccctgaaggcactatgaagtgtaatatgaattgcaagttcattttcttctgtcatgtttgactatttggtgctgatgatcttttgcaaagagaaaataatggataacactttctgttcagaaccagaacatgagtctcgaatgaccttaatttttatgcttgggccaaaaagtagaggatcctggcaatttcagtcaccattgtttggtcttcagtgctcataccatttccttaggtggttatcatattttagtttagctcctacattttaaatagatagtagagattcatttttaatgcttgataagcagccaagtttcaggcttaattcacttagtcagtcttgagtcattgctctatcctcactttcatagcaaatatcatcattgggattacaccacaatgttttccttctgaatgaacagtttcacagcttaatataggttagtattttcaacatgcttgattttcaagcatgcttgaataagtttacatgctagaaactggctgggtgcggggactcacacctgtaatcccagcaatttgggaggccaaggagggaggatcacttgatgccagcagtttgagaccaagcctatgaaacatagtgagaccctgtctctacaaaagatttaaaaaattagccaggtgtggtggtgcacacctgtaatcccatctattcaggaggctgaagccggaggatctcgtgtgttcaggggctcgaggctgcagtgagccatgatcacaccactacactccagcctgggaaatagagtgagaccctgtctctaaaaaaataaaataaaataaaataaatgctagaaactggttgaaagtaactgaacaggaggaactgaggatgtggcactcattcttggaaatcagttctggttaaagattaaaacagactctgctgctgtctttcttatgtaaatataaagtccaagggccacacatgacatagaaaaaatatcacttagcttctgtaaaactttttaaaaattccttctttaaatgtttcatgattatacattgtttgcaaagtaaatgaaacaggttaacttcctggatgcttacttttagcagaaatatatcagatagcaaacttgctgacagatgaatcacagctttgcccacctgtaatgaggatacactgctggatcccaggttggtcccagactttcagggtggtatttctggcctccagtccacttagggaactgatcattctgcatacctctctgggattatgttctccacctcatctggcccttgataggtaaacatcccctacctggccaaaagtaacaaagctgaaaaaacttggccaaatctgggaacttgttagtctgcctcttcctgtaccagaaccgcgttccagattgtttcccagggtctgacttcaggccactgttctttgctggccttgacctcagtacttgtcttataaatgactttatgcttttctccctctgcctcatcccaccctcgttctttgtatcctacctctaatttttatccttcagacactttttatttttctcccttgtttgaatatatttttagttttctctaggccttgcttaccaacctatcataccttccagactctcatgctccattccttccactctttccacctcaatctgttctacctcacctgaagactctgataacgagagcaaggtcttccacctgagcctgatggggttttggccagctgacattcctccatcacctaatggtcttagctgccttgtgtcctgtccacctgagatgacaccccttgcatccagttctttgagagaaataattcttattatagatttgtcttaaccgatccgtcaggtttcctttctctgactcatttagtcattactttttctcagcgaatttcatgttggatatacaaactaacaaagcagaacatacttatttcatttacaattttggtaaagttttattatgacacctcattttaggtgtcactcccattatcttgtttaatctgttaacatgcaataaagacaataataaatagaagggaataaattttatgagcagaaagtagtatttgagaattttctgtccatccatttagatagagatttaatagttctcttaaaggcattatttgtatgcccaaacttctgcttatagaccattgccattctttttttttttttttttaaatctagatctgtgcttctggtgtgtaaccatgaatataggtttgtatatcaaaacaaataaatatctacttgtacttgtatgagcaaaatcacccttgaaaatcctttacactttgcttgatacctcagagtttgttttgttttgctttttcatttgcttaggtttttaaaatttaaataaattgccacaatttaaaaatcagaaagtttcaacaaaaacagatttcaagtgcaaaaaaaaatttcgagatctctcaacaatgctacctgcatttctttgccgcaactatatgcttgtgctaaggagcatctgcctcttgacatgggaatgtgcttgctgctttgacacaattcatcactcacctacattacttgcctgggctttatagacatatgagtttgtgcttcttgtcttaaaggagaagcatagttggaatcaaagaggtaaaggcatagacttccacccagcaatgcttttcttttaaaagaaaataaaatatgtcccctaccccaaaatacaaagaataaaataacagtctttcatagtaccactacctagaataaatcattattaatattttggcatatttgttttcagattttttcccctgactaatcccatttttgtcctgtagaattttatttctatatgcaggggtgaatttcttctcaagaagtctccctcattcttaaaaatttactacctttttcctcaagagatataataatcttggttttgtaaagtccattagttttgtgcctaaggcattagactttcctcagatcagagactctcatggttcctagtcagaccattaggcccaagtcaaaaacatggttatcagttaatttcatagggatttaaataggataaagacacagctctaaattctttagtaggttagtttgtaagtgttcataaatgtggagcatttcaagccagattcatcttagtcctgaccttacttggttagagagttgtcaggccaacttcaagccaatggaagtgagatatgagtataatcaagtaagcatccagaccaaagttgagaaattcagctgcccttcatgtgtggtatcatatccacagtcccaagtcacctctattgcccctaaacctttgtacccaagagctctcccattaagaatgaatgtgaatccatttgacttttgctccagctacttacataatgatcaacctctgatttgtaattcctgtgcatgttagcaattctatctcaggtgtttaggatgcaaataattttttaaaaattagtacttggcctcctttgcttgctcccaaaggagaatttaatacatagtatgactgtgacatatgtatttattaaagtataaaatattttttcagttaggtgaaatatagaactcaacagtttggtatatagttggtgttcaactgacgtcaacttcttcctttttaaaaatatgtactattctagcaatatcatggattaaatgggattctgatagcttcagtttgtgttttattctaagtgttctaagtgtgataggtcattgtaaagttttggttcctgggtagagggtagactgtagtgtgaatagtggcctcttgggatagtggaagcagagaggacagtttagaggcctttgcagaagtccaggtgaaagatggtgctgattttaactaggagattagtagtggggagacgaggtttcaaggttgccctgtattttgaaggtaaagctaacaggacttactgctagattggatgttatgtgtaaggaaaagaaaggagtcaaggaagatccctgggttgaatcattcaagctttattgatttctttcccttaagacaccaattatccacgttatttctacctttaagaaatcacctttgaaccattttctgttattaagtggcttctcattcctccttttctgtcaccacctacctgtggaaggttacagattatacctgttttgtgaactttctaacagattttgaaatccctgttctttcatcaaactctcctgattaaggaaccaaagaccagactatttccacatagtttgttcagttggaaggaagggtttccattagctattccgttctcaaccaagttacatatgttgcctccttgctgtggtgcacttatcttttatttggacaatacctgtttccattcatatatttgctctgcaagtcttaattccgtgtttcaatatatgcgcatcaatataagtgcccatctttgattgttagcacctagagggcaattgttgtcttacttgtgcaattaggttctaaataaatcatttttaagcgatgataacattttgattccaacgtagtggctgtatttgataagaactttaatcacattttctccagtaattaggctctttttggctgacatttaaagtgatggaatggtatctttagaacatctggatttttcagaaggcagcttctgcttttagttttcaagtgttggcctctttaccacgctgagttcacaagttctccatttatgacggcatcatgcctttgccattctgccacatgcatcacataattcttgttactggaaagccacttttgtgtttgaaactatttcgaaagggatggaaaaatcccttattttaagaaaaattgacatcttatggtagtaatctaaaattttcattgagttggcttcaatactatgtttttatgaaccatgtgtagcaaaaggaattaattttctttgagtatcaccacacagacttttaggaaccaagaatgatttatttacttagtgtctaagatttaccaacttaagaatggaaaaatcctattggatcataagagactgttcccttccctactgcaggattatgtgctacagtgtatttcctaatctttgttctttttaataacattcttccggtattcatttgaaagtcattactccaaaatatttccatgaaattataatatcatgcctggttttagatggagataaatttctgatgtttgttttataatatccaccaaagtttattttttaaaaatattaagcaatatttatctctttaaaatgggacaattatactagtcccctaccagtttaaataatagcaatattttcttttactttactaactttattatttttggattagtgatattttgcttggaacatactatggactgcagattatttctcagatatactttagaaagaaattagcatggacctcaagccaacaggcaagcagatcagggtttgttttcttttaaaattttttttatttttaatttttgtgggtacctagtaggtgtatgtatttacacagtacgtgacatgttttcatacaggcatgcaatgtataataatcacatcatggaaaatggggtattcattccctcaagcgtttatccttcatgttacaaataatgcaattatatttttttagttattttaaagtatacaattaaattattattgactatagtcaccctgttgtgctgtcaaatactaggtcttattcattctatttttttgtacccattaaccatcctttcctttctgtccaacccccaactacccttctcagcctctggtaaccatccttctactctctatgtccatgagttcaattgttttgatttttagatcccacaaatagggagaacatgtgatctttgtctttctgtacctggcttatttcacttaacatagtgatctccagttctattttgttgcagatgataggatctcattctttttatagctgaatagtactccattgtgtatgtgtaccacattttctttatccattcatctattgatgtacacttaggttacttccaaatcttggctattgtgagtagtgctgcaacaaccatgggaatgcagatatctcttcagtatcctgatttcctttcttttgggtatatacccagcagggggattgctggatcatttggtagctctatttttagttttttgaggaacctccaaactgttctctgtagtggttgtactaatttacattcccagcaacaatgtctgagggtttccttttctccacatcatcatcagcatttgttattgcttgtctttcggatataagccagtttaactggggtgagctgatatctcactgtagttttgatttgcatttctctggtgatcagtgatattgagcaccttttcatatgcctgttcaccattcgtttgtcttctttgagatatgcctattcagattttttgccaatatttttttttctagagagttgtgtgagctccttatatgttctggttattaatcccttgtcagatgggcaattttcttccattctgtaggatctctcttcactttgttgattgtttcccttgctgtgcagaagctttttaatttgatgtgatcctgtttgtccgtttttgctttggttgaatatgcttgtagggtattactctagaaaattttgcctagaccaatgtcctggagagtttccccaatgttatcttgtcagaacttcatagtttgaggtcttaggtttaagtctttaatccattttgatttgattttttttatatggtaggagataggagtctagtttcactctttggcatatggatatccagttttctcagcaccatttattaaaaagactgcattttttctcagtgtatgttcttggcccctttgttgaaaacaagctcactgtaggtgtgtggatttgtttctggcctctctattctgttccattggtctatgtgtctcagtttacactgtaccatactgttttgattactacaactgtgtggtataatttcaaatcaggtaatgtaattcccctagttttgttctttttgcttaagacagctttgactaatctgggtcttttctggctccatataaagtttaggatttttttccatttctgtgaagaatgtcattggtattttcgtaggaattgcattcagtttttagattgctttgggtagtatggacattttagtaatgttgattcttccaatccatgaacatggaatatctctcatttttggtacccccttccattttttcatcactattttatagtttttattataaagttctctcacttctttggttaaattaattcctaagtatttaattttatttgtggctactgtaaatgggattacttttgtgtttctttttcaaacttgtaactgttggcataaacaaatgctactgatttttgtatgatgattttgtacccttcaacttcactgaatttgtttatcagttctaagattttattatggagtctctaggtttttccaaatataagatcacataatttgcaaacaaggataatttgacttctttttttccagtttggatgccctttatatctttcccttgtctgattgctctagctgggactttgagtactatgttgaataatggtagtgaaagtaggcttttttgttgtgttccagatctcagaggaaaggcttttggtttttccccattcaatatggtgctagctgtgggcctgctatatgtggctttattgcattgagatgttttaattctacatccagttttttgagagtttttattatgaaggaatgttgatttttatcaagtgatttttcagcatcgattaaaatgatcatttggttttagtcctccattcttctcttgatatatcacattgattgatttacctatattgaaccattcttgcatccccaagataaatcccacttgaccatgatgaataatgtttttaatgtattgttgcattcagtttgctagtatcttattgagggttttttcattaatatttgttgaagatattggcctgcatatatgttttttgacatgtttttgtctggttttggtatcagggtaatattggcctgatagaatgagtttggaagtattccctcttcctctgttttttcagaacaatttgggtaggattggtattagttcttctttaaatggttggtagaattcagtgaagccatcaggtcctgggctgttttttactgggagaaattttattacagctttgatctcattacttgttattggtcagttcaggttttggacttcttcttggttcagtcttggtaggttgtatgtgtctaggaatttgtccatttcttctagattttccaatttattggcatatagtttctcatagtagtctctaaagatcctttgcatttcagtggtatcagttatcagttgtaatgtctccattttcaactctgattttatatatttggatcttctctcttttttcttagttagtctggctgaaggtctgtcaattatgtttaacttttcgaataccaactctttgtttcactgatgttttgtattattttcttcatttcaattgtatttattgctgctctcttctttattatttcttctactaattttggatttggtttgctctgcttttctagttctttaaggtgcatcattaggttgtttatttgaatttttttgctttccattgttttaatgtaggaaaaggcagaattgctagactcatgatccggacatgaataacttgagtaataatatacataattaatattctgaagcaatttggagatgcacatctaaacctgctaagcctctctgtaggtggcttccgtttacggtccatgatttccagaggatagtacaccagcacttaattgcccatcttttccaagttaagatacatatatgaaatataactcaggaatagtttaaattaatccacatatttgttattatgggcattatgaatacattacatggtggcattgttgacatttctctttttaacctcatggtgtacatattttatattcccaaatatagtttggaaatcaaatgacttataaaaaacaaaatagttaactttggaaacaaaagaatgagccctaatgttatgtatcactttggttggattcacatattgtcctgaagcagtctataattaaataatcatttaaattaataaatattattttttgtccagcaaaccagataaaaatctgctaatttgctacttaaaaattggcagtggctcttcagtgcctcgaaaacaaagtctaacctccctaacatagtgtatgctttagtaccaggccacattttagtcctaccttccatccttccctttctcacaccttcttcctgccccacccctcatatgttagtttgtctcatatctttttccttgtggattccgcaatccaaattttgcccttctgccaactgtgatttctcccatctttacctggtgaattgctattcatccttcatacccaacctcaaatggctgggcatttgaagactttctggacttgattaggtggacctgaaatattttatattctctagggttttctaaggcagagatgaaactttcttcatctctgtattcctttcttcatctagtacctaccacagtatctgctaggtgttcgatggtaggcatattgtaggagcttatggaatttgccaaattattttttgtttttgaaatagagtcttactgtgtcacccaggctggagtgcagtggtgcagtctcggcttactgcaacctccatctcccgggttcaagtaattatcctgcctcagcctcctgagtagctgggactacagaggtgcactgccatgccaggttaagttttctatttttagtagagacgggctttcaccacgtctctctggctggtctcgaactcccgacctcaggtgatctgcccacctccgcctcccaaagtgctgagattaaaggcgtgagccaccgtttcaggccggaatttgccagtaaattaatgttacgataatccatacatggatagattatacttttttatattatttaatttaattttaatttttaatttttgtgggtgcatagtaggtatatatatttatgggttacatgaactatttgacataggcatgcaatgcataataatcacatcggggtaaatggggtatccatcacctcaagcatttatcctttgtgtttcagacaattcaattgtacgcttagttaattttaaatgtataattttttatgatagcctgttatgctagcaaatactagtatatacacattctttctatttctatacccatagattatgatttaatgaccacttgccaatatttcctattctgattcttcatatttcacatatgtgaagaaatctgtgcctattgtattttgatacagactttttgcttgcctttactttgaattcagtggtagaattttattataataacctaagataaattacctaatcttatgtaagtatatactaaatattgtgtatatgaccttctgcgcatttgcctgagtgaagagtgatatattattaaagggactctcggaagcatttaagaagcattgcctattaaaaaacaaagtgtaacatgaatccatagctctccaggtgtttggaatctctttggaggaaactcatacatgaaacaaacaaacaaaaatgtaaacacagttgagttaaaatgctcagaggaataatcactataggaattcagagaacggtgtgttgagattgttaaagagtaagggaggaagtaggattttagagtgattttaaggatgagtaggagaggagtatattgcgggagattgggagcattagagcagaggaacaacctctgaagagagtaagaaatctttcctttccttggtcccttcttatgccatcttttctctggacagtgttctttgcctgctgcgttgttgctcagggtcacattagcttagttctgggaaagcatccagtaggaaacgtgtaagaaacttcctggccatagcagaaaattgctgtagtatcaaattgctttgttgcttgggcctcacatctgtttccttgccctttcaccaacccctgtgctactaaagtggatctcctgattcctgagtccttgatcttttgaccattccaaaatgttgctattatgccttggtgctctctgcctgtttgatttctcctctacctttcttgtctgccctcctgtgacctatatgttgtaacgtttgcctggctgaagtctgaagactcagactcttggctggttagtatagctggcttactgtccagctgacccactccataggtgatattcccaaccagacaaattggagtcctggtctcttgcccagcttcttgttctgtcataacaaccaacttgcttggtatgaagggttcatttgtgggaatactaaaaactttgtgagaatacgcaaaaagaaaaaaaagagagagagagacagagagagagataaagctaggctgtggaaagatttgcaagaaaggttgaagtttatatttcgttctctaggccagtgaccttcaaagctcaagtttgcacctcaaaagtaggcaagatgatccatggggtatggacagaaattattatattataatgactggctcagtgtgtttctatctttaaaaagtttttttctaagaaatacagttatttaaaatacagaagaaacaaaaaaaccaaacatttaaaatataaaataaattaaaaatacaaatgtttaaattgtggattgacccaagtcaccccatgtgtcagttggtcacatatcaactttggtaacaggcttctggaggaaagagtatgaactccgcgtcctggaggcgctgacagcaggaccttactcatttattcactttcagcttgtttgaggtattgctgtttatgcgtgcctagatttgcagattgtgtttttagccttaagcaaaataacatttgtaaagtggtcaagtgcctttaaaagattcctgccaagagcctgcaggttgaagctactacttgtgacgcagtcacatggaggagctgatacttgtgctcctaatactagctttagccacacttagagcaaaaatcagtggtattttaatcagatataaccgaacttctaccaccaaaagttgataatttccaagaagactattagaaaagtgaatgtatccaaatgcctttgacaaagaacctcaccctaagtgtatattccactttgagataatgcacattgtgaatatagtattatgattagccagtcatttaaaaatcgtgtttatttcatttttatactcaacctttaaaatgcccacttttaatggacacttttagtgtctatgtttagttttatatatatatattatctatctatctatctatctatctatctatctatctatctatctatctatacacccgcacacacctgtatgtatttaattttgagaataaacatatatattatagataaatatttatattttgggcacatgatcaaaaagttttcaggggattattctgtggtcatctgattggaaatttttagagaatacaggtactcccagtgaggggtggtttctttaataacaagaaactgaaaactgactgaaaatctaatcttttatgaaaattacttcttagatgctttcagaaatgttgcttcttaccaatgtgatacataaaactaatctcgtttgacagtggtgatgacaagttttttaaatcagttttcctatgtattcctgttacagttttggttgtttatttgaaccttgaaacaccagagcaaaaggaggatgatgttaacctagtatgatatggttattgtattagctaagtagtagctatgtcttatttaatattaaaaaacagcgagtaattcgtgtgttttctgtccgttctacaaataaacctggtaatggagttttttcagagaaccataacatctgaaacacattcgatgggtttaccaaagaaagtaattatggctgtaaaatctgtgtgactatttttaagtgaagttcttcaggaaaagggggtagacagcataatgagaattctatttttaacttaggtcacttttttcatggactgacaatgctgtgactttttcagacagacaatgagccatctagcttttgaactctttcgtattctgtaaacattaggaagcaccagtgtgtctcctaatgtaaacacactgatccagacctcatgaggtatattcatgatcatttactttgtttattcaaaggtcattaaaagatgtgatttagatttgttttcttaatatttctgtggaaactaaaaagctaatctacaatgttgttttacatacaggtttacctgaaaggaaaataaagtttattttagcttttggcaatttttattgatataaaacatataaagtgagtcacacaaaagttgaccttgaaacttctcatttttcatgttagtggttttaatactattgcatttgaaatttttaacttttaataaaattgggttaaattgtatccctccttttctttatatatttattccgcctctgttatcttatctttctgcatctttagaagattataagcttttggaatcagaaacaatgtcatagacttttcttttttttgtcttcccaggaagttgattaaagtagaaactgtcatggtcccacagtttcctccagtagctcaggttgaggacagattatacataggacataaggaaacagctgctaagtctcctgttgagcagcagcataaaagcagcatgtcaggtctgcagtactgggttcaaatcttggctctgctaattctaagctttatggagtgggaaattgactccatgagtcaatctcatggagttgttatgaaacatgtaagtttcctaacaaggtgcttggtaagcggtaagtacttcatgaatatgagctgtttttattatcagtatgattacgtggaaaagagaaccttgttagcaggggtatttaaggagaaagtaacttctcaaaaagaccagtggtgaaagcagaaaggctattgcagtgtggatgccaatgccccttctaaggaagcaagcaggagggaaagggaaaggagaagcagctggacagaagcacctgtgtcagcttaaatgacagtaccaaacatttctcctgaccttctgccagcatcatctttcttaaaaaataatttcaacttttattttagattcagtggttgcatatgcagatttgttagttacagggtatattgcatgatgctgaggtttgggatacaaatgatcttgtcacccaggtagtaagcatagcaccgagtagttagcttttcaacactttctcccctccctccttccacattctagtagtccccactgtctattgttgccatctttatgtccatgagtacctaatgtttagcactcccttacaatgtggtataagtgatattggttctccataccatggagaacgggggttatttggttttctgttcatgtgttaatttgcttaggataatagcctccagcagcatccgtgttcctggaaaggacatgactttgttctttcttatggctgcaaagtatcccatggtgtagaagtaccacattttctctatccagtggactgttgacaggcacgtaggttgattccttgtctttgctattgtaaatagtccagcatcatcttttgctcaaagttaattaagtccacttctcaatcctatattttccacatttatttctctgtagtagaaatttgggactttgatgttggggttcgaaacatatttttattttccttcatgaaatactgcatgagaaacaagactaggcaaacattttaacttgtaagtagtaagtttctcattattaaaatattcaatgtataaatcatgtgccacacttagccaggggttcatttttccactggctaatttggggccccaggaaaactgagcattatagactgtggaaatatagccagggccttctcagtgattagatattactgagggcagggtggaatcagtgctctgcatttatcccattacagctttggagtgaaagtgtcacctcttcccatagcagcaattacactagcaattagagaatcaacacttttatgaatttcacatctggcccaaagtacaagcctgaatttctagactttttactataattatcctgttatatcaatatttatcattttcttagtgggaagtcttatttttataatttggtagaagttatctaaccaattagttctaataaaagtttaacattaaaaagtggtagcataaaaatagttttagatttaatgattcatatacacatcacattataaaatgtcttttgcagtaaagttaaataataaaatgttttaaatgtctgagttttattttttttcttcgttgcaggaaatttacatttgatgaggaaactaaatatcttccatttaaagtcataggcctagtttatcataactcatgcttctcttcccattttagagtggttttctaaatataatcacaaagtatgaagtttctttcataaaaccttattctgaaatgagttccatgtgagtgtttacagggaaaaccaagccaaccaaaaggcactttcaagattcatgtgtttgctttatttaaaaatatctataattagttgctcatagataaatgatacttttgtcctgcctcaacatcataaatctttgcgggtgaatattgtgctataatgttttttcaccatgatatgaattttaaagacttaataagcccctcttagcatggttactttaacagggaaaattgaacccttggtttaacatatgaagtagtgagtggggctttagtaatggatccagatttagctgaataatacagtttgaatatcccttatccaaaatgcttgggaccagaaatattttggatgtggggtttttgcacattttggaatacttgcattgtacttatcagttgaacatccctaatccaggagcccaaaatgctccaatgaacatgtcctttgagcatcatgtaggtgctcaaaaagttttagattattgagcagttcagatttcagattttcaggttagggatactcaacctgtaacactaaccttaattgaagctttaccttattccagacgctgtgctaaatctttcatagagactcgtctcatttaaacctcacaacaaatctttgaatgagatactcttcttgtccctatttttaaaatgatgaaactgagtttaaataaaactgtgaatgtatttaactcttctaagatcacacaactattaagtggagataaaccttaaggctagatgaagagttttaattttatgttgagtaaaacatacctttacagcaaatgtactattaatatgtaagtcaaagttttgtaaatgtgattattttatctaatctttaattaataaaagagatgatttccccatttctgattgatttttacttgccagcagctgctagatcctttccattaagtttataggtcaagttgttaataatctttaaacagcagtttaaacctaccagctaagtttatttattaacaacaacagaaacaaaaacaacctgtttttcaacattccttttctaataagcagttgttataggaccacaatggaatatatgttaattgccttcaagatctcttaaaagacaaattctctaagtaaccactggagcatttatgagcaaagagattttattgtccctgcctacatgctcccctaaaaactggatgagttgtgatgtaactttttttcttctaagaaatttaacagttacagaaaattcaaagaatataccaaatatctccataataaaatattactactgttatattttccttcaattattttgttaagaaatattgcaaacataaacttttaaaaaatgttcagtattattaatttgtgggaattatttattacctagaaaatgctcacttatccagacagcgttctaaaagtaatcatagaaaaggtattccaatgtactttaggataatatattcttaattatcgtttgtatagggcattatttattattttaaaacagcaagtaaagaatttaaaatgatcagtaatctggtttaaaggactctgatgctaaaataattattttgagatttgttgtgtagaatgactggattttgacttaagaattcagtggctgtttaatccccctgactttagtattacttattaatctctgtgtcctttggtcaggaatttggggaagagccacatgaactgagcatgactaggtccacaagcttgtttatttgtttttccgttgtgactgaaggctaaactcttttagaaaggcaaaaggagtctgcaaaaattaacgctgattgtgagattggtggaaagagggtgggaacaaagtaaaaaatacacatcaagttctaaaattagccactgtgatcaatgcatgctaccaagggggtgctgctggctgacctatgatgggaagaccctcccccagcccccgtgggtgctgatcatgctaagttggcacgcttcatcattaaacaaagtactaagattaattacttcaaaggggtagattagttgattttaactgtaaaaatgcacatatttaacagtttagcatttcatgatttatgtgtataaacactgagactctaatggtaaggcgtttggccatacctaacataatttatttgttcatactttcaagcccttgaaagtttttgatccccttatatttaaggtggcaggttttggtttagaagggtatgggcagagaatgttggcctttctgtagcatttctaagaggtttttgagtgtgaactagcaccagggcttagggaattggagagataggaaggaggggatatttggatgcaagatgtcattggcctctcactgagtattcagtctaggggcaacctagccttaattatgtttttatggatttttttttttcaagaatcccatcccagtgagttgtttagaagcaggattatatttaataaggcaatggcaattttttaaaacatggatttaatataataatttttcatttcattttaaatgacaatttaataactgacttaacatttaaatatatgaagatattttttaattggtaacatcattacaatgttttataaatctaaaagaaatttaaattttcaacaaattcaccactaatactgggggacaattctagatcaattgattaggcctcctttttgatgaggcccaggcattgaatttttaggagctctgctggtgatttcatgtgcaccccaggtaaagaagcaatgttttatatagtttcatccacagtgtacatattattcgatattcaatttacatattctatttcacttaattttatagggaatattttccttgtttcttcagcgttcacaaatttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgccctgccacaaatttttaattagaatgtatatttgtgtatctcaatttattaaattattcatataatattgaatatttcattgtaagttagtagaaaacaatggtgcagtatcatttgatttctctgttgaatcatttccagaccatatcgaaaagaatgaacaaaccttgctgtttgtagttgccacattgctttcataagggatgtagcaatcacaatactatcagcaatgagtgcttgtttcaccacaactttcctggaattgggaattatcgattactaaactcattttaaatcttcattgttttcaggactccaaaaatgaaaagaaggggaaaatgccacaaatagctatgtttataaatggagccattggtagttccctggaagtagagagatgtatacagtgatgtgcctacaactagatccaagtaggttattctaatttaagtgactttttaagtcattaccaataaaaactttaaagatataaattacctacaaccatcaagaatggataaaaattaactactacagcttgtgccaaccatgtgctagcagtgggaatactcaaaataagcaaacaaaacttcagtgaatcaaaacaaaatcaacaggtgtaacctgcttcacattcttcaagcttatatcaagctctgaatctgccaaactcctgaggaagtcagtttcctgtataattgagagataagctctattattgagagaaccaacttctttccttaaaagaataaaccagctagagtctcattttgtattgtttattatcccttgactacagaaagcgtgctaccaagcagaaagcaggctttgtcacaaataccaagaaatccagatgcttagagaatctgagtttttattgttctctttctcctcttcctctccctcttcctctgtcatttgtaccatcatcatcttcatcatcatcaccactatcattttttttaaagaagcatttgtaaagtgctcattatgctgggtactttatctgtcttattttatttagtctttattggtagtagctcttaggcagatatatttcactatttcatttttcaaatgagaatgagctgcaaaaggatgaatacctaattcaaggttacacaactagcaagagcagaaactggaatttgactgaggcatattagatcctacgatctgaatagacttgctaaggctgtttggctttcacagttcagatcagtttagagtgctggatcagtccaatctggtggctgtggcaggtgctaaatcttgtaggaagtagtcccaatgtttgggaccagctctggttttagtgaccccacagaaagcctaatttgactttcaggaagcctgcaatggttttatgacggaccacatctactagactaagtgaaagcccagatccggagagaaatgatccaaacatctatttcccagtggccagatctgttttattaagaatcacattattaggtttcaatgttcgggctattttcagcgattttatctcttgcatcttctacatccatgagtcaccaagttcggtgtgagaggtagatagcaaagattagtggaacaattatagaatttgaatgtacatatatctgagcttgaattccagccccattagttagtatttttataactttggatactaagtttcttaatgtctgtgtgcctcagctttcttgtctttacactgtaaataataataagtttccagggttgttatggagattaaatgagatatctatatataaacatgttatgcaatgtcttgcatatgataggctttcttcctcccatgtatatttactccacaatgattatttaaaccattattttatatttccacttcttatgttactacaaccaaggcctccctctctttacctcttagtggaagaaatttacaccagccataggggtctttctcaattcctcctttaattgtgtctgtccttggtttaggaattcacagtgtgcataacccagagacctaatcaatctggccatagaacataaccctgccctaccctgcctgatgcatctcatacattttgagttacatttctctaaaagctttgttttaatttgcctgctaaagatcatcctctggttttctggcaatacataaaacatttcaaattacatgcatcctcagatatcaaatccaaacttctttttctagtttttaatattttccagctgctattagcttccttcctgtcacccagatcaagaaccacagaatcgtaaaggagcatagaactcatgtaattatttccttttagcccaaatctactgttcctatctcatatatacttctcagcagcatctatatattcccaaacaatggatgaaagagaaagccttgcccgatcataaaagcaatgttttctgattactagacagatggtatttagataggattggagacttcaaaatgatgttgataagagaaagtaatattgggaggtgtagttgatacatataaaattctgtttttacaccttctaatttgttcactttatttttctgggtcttatagtgattatgactataactgagataaaaaataacaactggactttgagaaattaaagttgttcctcaaagtgatctcttttcttgctaaaatgtactataattattaaatgtatttgtgattcaggtaagttttagtttaagctttgagtgtcgtttcattaatggaaatacagataattgcttgagaactcattaaatgtatgtactactagaatagaaaggaaaaatattttgggctgggcgtggtggctcacacctgtaatcccagcactttgggaggccgaggtgggcggatcacctgaggtcaggagttcgagaccagcctgaccagtatggagaaaccccatctctactaaaaatgcaaaattagctgggcatggtggcacatggctgtaatcccagctactcgggaggctgaggcaggagaatcgcttggacccaggaggtggaggttgtgatgagccaagatcgtgccattgcactccaacctgggcaacaagagtgaaactccatctcaaaaaaaaaaaaaaaaaaaaagaaaaatattttggaagagtaatatttacataactgtcttagcctgttcaggctgctataacaaattaccatgggctgtgtggcttataaacaaccaacatttatttctcacagctctggagactgggaagttctaaatcaaagtgccaacaggttcagtgtctggtgagggcccacttcctggtttataaacgttttttcactgtgtccttatgtggctgaaagggccagcgagctctcttgggccatttttataagggcaggaatcctattcatgcaagaggaaccctcatgacctaataacttcccaaaggctcctaatgccatcgccttacgggttagagtttcaacatatgaattcggggagacgcaaatattagaacataacaaatactcttttgaaaatggtttactggcttcctaaatttaaaaaaaaatttctcttcagagtctttttacttttcattattttacattcaggtgcccactagaatttatgtacctttaacagatttaagagttatttctaatatactagtgagaaatgattaatattttatagctgattcctataataaactaacccaatcaaaaatattttattagatgaattagagcagttatcatctcattagtatcttttcctctaattactacagaatgtaaaatttatttatttctcctcattataaggcaatttcctagagtgaatagcacaacaaaaatagtgtaatgtttagaatgtaaatgtggaattttacacattccattttttaaaaatctaactcagttcccctgtacttactaaaattcctcttctaaatgtcattaattaactactggctgtcaaattcaattgtcattttctatttctcatcttcctttgttattgttaactgcatcctactttgtaaaactctctttcttttctgcattttaggtttaaattttgttatcaaatcatgtgaactatgtaaaaagtgagcacttctgtacctgcttccattttaataaataaaacactatcaacaaatttcaagttccctatgtgttcctcccagattgtatgttccttcatgcccaaatgaaagtgtaaccattatccaaacttgcatgtttacaatcacatgcattttaaatattcttttgctacatagtatgtacctgtacataatgtgtcatgtcatattttggtatattttaacttttctttaaataatatcacactgtgtgaatgggtgtgttttttagcacctattttttgttttttgtttcatcattcaacattgtttttatgacagtcttccttatttatttatttattgcttttggtttctgggggtcttgtaattgactgccttctcttctagctgcacaacctctccctatgtattccctgccgcatctggcttctataaacctttcatatttttctcagatccaggactgtctaaaaacctactgaatatctccaacaggatatcccacaagtaacataaacttcatccttcaaaatgtgagtttattatcatctccccagagctgcaatttcttttgctttttctttaactcaaataatggcacactatcaaccctgccatctgtgctgttaaatttagtcattgtgaaatccctggtgttctttacccttcatggctacttaaatcactaaatcctctagaggctaaaagtaaaaactaagctgctggaacaagatatattaatgtagtaatgcatatatgtataataagtaagaccaaacccaataaagttgtgtcttgttttttttttttttttttttctacaagagtctgagatgtctgagccccaggtcaatgcagcactacaacatgtcttccatcttcagcatgtgacttccgaggtcatccttccagcctgtgggagagaggacagtgcaagtccggggtcaaaaactgactcataagcagggcctaagttgttcaatcacttctattcacactctactggttgcaaggggtctaagaaaaacagcacctaagtgggtagccaccccctcgccctaactctatcagtattggaggatagactttggtggacagtcccgtatctgtgccacacataggttcataaatgtcttccagggcctttccttctttacctcgtttcactgccacactgtatggtgtcaacatcgcttgcttaaactattccaaatagtcttttgactgattatattttcttcttccaatccatctcctatgttaatgtcagttatctttctaaaatattggtgttttgttgttgcccttcaggaaaattttaagaagtccagtatctctctgtggcctctgaaatttttatgggataaactatatgacatgtgacaggtatatagaatacttacaacgtggccttaggttgtttctctggcttttcactcattccctatattctatactttgaacacatttgccggctcactgtcacttactatgtcgtgtattttcatagctttatgtctttattttcggagtctcctgtgtctggaaagctatttttcccttcttcctctacagtggtcacctcctatcagtagctttcctagataaccttacaactaaccaaagcagagctcattgctgctttcccggtgttatcatctatataaaccttgctactcagaatgtggtctgcagaccagtggcaccagcctcacttggaagtttgttagaaatgcagaatgctggacccaacctgacctactgaattagcatctgcatttgtaactagttcccatacgatctggtacggctggtcctcaggctttagaaatagcattcatcatattaatgacagttggttcttgatgcatggtctcctgtaggccttaagtttctcatgcagaaactgtatcttgttcaatgtggagccctcaaaaccttccacagagtatctgctacatagtggctcctgctaaatttatactgagggacttgatttgtattttgtcttatctaatggtcctataagaagttatgcttagaatttgggtgttttcagcactaaacccaccaaattatttatttctatgagaaatagaagcatttttgcaccttctaaaccatatcctttgaaacttgtgagcattacatgaatgtgcatgcatcacataatttggataggatttattgcagtttatgattataatttttcattatgctgctaaaggaaccattagctaaaaggatattttcataaacaaatattatagtaagggctagcctaatgtatataaaggataatatatatttttaaagttagaaattgcctctaatttttaatatgtactataaaatccacacaatttagaaattttctttgaaatcaatttaaaagaaattgttttttaaaaagtatgtaagtgtttaaatatataaaatttaaatatatactaaaatataactctgaaatttaaatatttactaggatatatacataaaacagcttgctgcattgacctggggctcacacacctcagactcttgtagaagaaaaaaatcaaacaaaacaatacagtcagtgttgcaagctgcaatatagaacagtcccaatcttgccttaggttatttgttctttttttttattattatactttaagttttagggtacatgtgcacatcgtgcaggttagttacatatgtatacatgtgccatgctggtgcgctgcacccactaaatcgtcatctagcattagttatatctcccagtgctatccctccccctgccccccaccccaccacagtccccagagtgtgatattccccttcctgtgtccatgtgatctcattgttcagttcccagctatgagtgagaatatgcagtgtttggttttttgttcttgcgatagtttactaagaatgatgatttccaatttcatccatgtccctacaaaggacatgaactcctcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtgttttggctgcataaatgtcttcttttgagaagtgtctgttcatgtccttcgcccactttttgagggggttgtttttttttttcttgtaaatttgttttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggtaatgcctaggttttcttctagggtttttatggttttaggtctaacgtttaagtctttaatccgtcttgaattgatttttgtataaggtgtaaggaagggatccagtttcagctttctacatatggctagccagttttcccagcaccatttattaaatagggaatcctttccccattgcttgtttttctcaggtttgtcaaggatagatagttgtagatatgtggcgttatttctgagggctctgttctgttccattgatctatatctctgttttggtaccagtaccatgctgttttggttactgtagccttgtggtatagtttgaagtcaggtagtgtgatgcctccagctttttcttttggcttaggattgccttggcgatgcgggctcttttttggttccatactaactttaaagtagttttttccaattctgtgaagaaagtcattggtagcttgatggggatggcattgaatctgtaagttaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctattattggtgtataagagtgcttgtgatttttgtacattgattttgtatcctgagagtttgctgaagttgcttatcagcttaaggagattttgggctgagacagtggggttttctagatatacagtcatgtcgtctgcaaacagggacaatttgacttcctcttttcctaactgaataccctttatttccttctcctgcctaattgccctggccagaacttccaacactatgttgaataggagtggtgagagagggcatccctgtcttacgccagttttcaaagggaatgcttccagtttttgcccattcagtatgatattggctgtgggtttgtcatagatagctcttattattttgaaatacgtcccgtcaatacctaatttattgagagtttttagcatgaagggttgttgaattttgtcaaaggctttttctgcatctattgagataatcatgtggtttttgtcttgggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttgtattgattggaatagtttcagaaggaatggtaccacttcctccttgtacctctggtagaattcgtctgtgaatccatctggtcctggactctttttggttggtaaactattgattattgccacaatttcagctcctgttattggtctattcagagattcaacttcttcctagtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttttctttattagtcttgctagcggtctatcaattttgttgatcctttcaaaaaaccagctcctggattcattaattttttgaagggttttttgtgtctctgtttccttcagttctgctctgattttagttatttctagccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttcttccttcatttcgttatgtacccagtagtcattcaggagcaggttgttcagtttccatgtagttgagcggttgtgagtgagattcctaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtttaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggcattctttgtctcttttgatctttgttggtttaaagtctgttttatcagagactagtattgcaacccctgcctttttttgttgtccatttgcttagtagatcttcctccatccttttattttgagcctatatgtgtctctgcacgtgagatgcgtttcctgaatacagcacactgatgggtcctgactctatccaatttgccagtctgtgccttttaattggagcatttagtccatttacatttaaagttaatgttgttatgtgtgaatttgatcctgtcattatgatgttaggggtgattttgctcgttagttgatgcagtttcttcctagtcttgatggtctttacattttggcttgattttgcagtggctggtactggttgttcctttccatgtttagcgcttccttcaggagctcttttagggcaggcctggtggtgataaaatctctcagcatttgcttttctgtaaagtattttatttctccttcacttatgaagcgtagtttggctggatatgaaattctgggttgaaaattcttttctttaagaatgttgaatattggcccccactctctcctggcttgtagggtttctgccaggagatctgctgttagtctgatgggcttccctttgagggtaacccgacctttctctctggctgcccttaacattttttccttcatttcaactttggtgaatctgataattatgtgtcttgaagttgctcttctcgaggagtatctttgtggcattctctgtatttcctgaatctgaacgttggcctgccttgctagattggggaagttctcctggataatatcctgcagagtgttttccaccttggttccattctccccatcactttcaggtacaccaatcagacgtagatttggtcttttcacatagtctcatatttcttggaggctttgctcgtttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcagttccctgtattgcttattctagttatacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgctttttagagtttcccgtttttctgttctgttttttccccatctttgtgtttttatctacttttggtctttgataatagtgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttccaggctgctttgtttacctcagcaagcctgggcaatggcgggcgcccctcccccagcctcgctgccgccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccaggtgcgtccgtcacccctttctttgacttggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctggcttctgcgtcactcaggctgggagctgtagaccggagctgttcctattcggccatattggctcctccccccaggttatttgttctaagtgctgacaacatctcagattaaaagttgttttcagtgctattctttttatgttactattaatgattaggcacattttctttaaatagcttttgatcatattagttggtacagtatggattatactgcattgactacctttaagttgttgactaatatgtagatatgtttctttttttctgtacaacgttaaggaaagtaaatgactgtatcctacagaaacattaagaaatcatttttaagaaaagtttccatttctgcttgtattttagtttagttttttatccatattctgttttatagcagatgaattttaaaaggccagtctatatttaaaataggcattaattttagccatgggtgttggctttccattttaatggcctgaccactaaacatcttctttttgttgtttctttttaaaaaatatatgatttgtctagcaaatctttggtaaaaaaaatacatttcttaacagtactattttaaggacagattatgctgtgattttgctgcaacagcctcctgagtgatagagtcagatgttctactttcttattagaaacatcgatgccaatatttactttcagtcctggtctaacaaaatgaatacgttgccagaggcatatcatgagtccttccggcaaactccaaataagaaacaaacagaaatagtgaatgagaatgccaacttaaaaaaaatacgtatttttattatagacttaattggccaagaacattcctacataatctaaaattcataacgaccaaatggtaatacttttattgcctgggtggttttgtacatggacttttataacttggtattcaatgtatgaattcttgtcaatgaaacagtatcattttgtgtctgagtatttatgtgtcttttttaaccaaagaaaaaaggaccaaatattagtgttagccaaaattttaatttttaaatactagagagttatttctaaatttacgtgagtccaaattttcaagcagaaactataatcctcctttgcttacctgataatttttactgccctaatcaacttggtcttgcactactgtaaataacttacatgaggaaatattgtggtttcatgttcggtaacaataattttacctaggttttaatgaaatatctctcacaatatgagagcctgcataatatagaatatccaattcattaaacacttgcagagggtcccctctgggccatctgggattactactgcctaactttgaaggagaaacctaaccagaatattttagtatgttgcatcagtgataagaaaacttctgaacttgtgccatgagacctcagagaaggggccactttgttcatcccaaggtgactcggaatagatgacaccaaagctgaaagatttgtagatttttttataggtgaagagagagaggagggagaaggaggtacttgctggaagtgtgtcctggcaaagcaagcagcactggtaaaagcaggcagatccgacagaatgtcgtgtatggatggagaaagagaatgaaacagcagtttaagatgactggtgggtaatgcaaatttgagaagtcatgggggatgaggctggactggtaaacaagagctaagtcatcaagggccagatatcaaacaagtttatacagtgaagatttagggcaaaggggtgatgtggaagggatgagttttccaaaaagttagtcacttatccaagaatgtatccagctcacttaatgaagctagctcacttatggagctagatacattcaaatagtttctataaatcaaattccttttcttagttcagttctcctagtgatgcccaaattgacaaatttcactaggtaaaatgtttgcttttcttgaagtaatataattctacctggaagtcagcatatttttaaaaatcacaaattgtaagaaaaaaatcattttgcttatgtgccaaattttatatgtgattatgttgaagtatggaaaacagcataattcaacaaacattttattaaaattgacaacacaatttcttaaaagaaatattttaataatggttaattcctacttgttagtctataattacgcatgtttcctaattgatgaaaagaaatgaaatcactctttctggacaggcatatacttgaaaatcctttaccgtatattggcttagagaaaaattgatgttccttgctgcttaaataaatttaagcccctaaaatctgaaaacttaattgaatatttagtggacataaaatgaatggtccataagagcagaggcacaaagttgaaacagcaaagataagcatgagggactctagctttagatttttactttactcactttgttttattttccttctccacataaattgttataaattttccacttgctagaagggatttctcaagcattgcagggcagcttagtttattttcttcgtgggtaaatctgtatgtaatcattttagcaggtgagagaattcaaggaagtggtaacttgccaggaaatgagttctcagggctgtgaatgttttttcattagtggtatgatttcccaaatatcccatttcattttcgtgtaaaaggtacttttccatctcatcacgtctacattgagttagtttgcccactaggaggcactctttccaagctctgtttcccagggtgtcccgctgactttccccaataaaaacctgtgggtatttactcatcttttgtgtttttgttactaagctaagttttgtaccttgcttctgtttgctagtggaaatggccttttttgttgttgtttaaaacaaaccaacaaaaacaacttccaaatgttttggttggtacttgtttttcaaggtactagtttgtggagagatgcttaacttactagaaaaacacaatgtgtttgatatcaagtgttcactaaaagttctactattacctttaaaatagtaatattctccctgatatttattttcaaatgtaaaaacatatagatctctaagtatagctcagttgtgaacaattgaaaacattaagtcaccatagaatgcatcgctgcaaaagacaaacagtgatttgtgtcagaaaaagctttcagattaaaaaaaatcagagaatataggcttgtcgtgagttgtgtgtgtgtgtgtgtatacatacacatagtatacacacatacatatatgtatacatgtaaaaacacacagcaacaagactgtataaaaaggacacttgctcagtggcatgtgaaagtcactctcatcacacattgtgctggtcacatattgatatgcaggccccacgtatataattatacgtataaaattagagttattagtgatcccggaataatcactctctgaagacttttaatgaacttcaaattgaaagtggttggtttacttaaaaagcatgatttctcaaattttttaatctcagagcttgagacctggtcccatcaattcattcacttattgagtgtctgctctgtgtcgggccttgttctatattttgtttacggcaatgaacatacaaacaaaatttactcatggtgtttatgtttggtggtagtggtggcaaggcaggggtgcacaccagagtaggattaattgcaatgacaaagggtaatgttgtaaaaggattaagagtgttagaagcagaactattttatatagggatgccaaggaaaatgtatctgagaagatactatttgagcagagatctgagggaaatgaggaagaaagctatgcatgtagctgggggatacattccagataaaagggcaaagcaaatatagtcctgaggtttattttaagggcagtaagtgagtctggttctggaatgtgagggggagtggtgggagatgaagttagtgagatgtgccaggacctagtagaatttttctccaaatgagatagaaagtcactggcagggtttgtgcagaagagttggttgatgagactaacttttcagagaatctctctaacttttgagttgatttggtattcaaaaaccctcactattaggcctctacttggttctcccgggaagttctctgccctccaatccttctgttttttgtttaggttccttctgcctggaatgcccattttcttgtagcaggtgtgaatctcagtccacacacagagatatgtgaggaatataactatttgttcacagctgaattgagccctattctgctaggtggtatgaacaatctgtcaattctggtctcctttggccttattctgtggctgcacgtaggcctttggggactcttgtaacattgagccatctagggaggtaggcaaggggcctgtcgcaggcacagctgcctagacacagactgtagcctttctactccagaaactatttcagaaaagtagccatgggttcttactgacctcagatccctaaacctctgcaggggttttgtctgttcttcttgctggaagttggcatagtctcacctcattttttcactctctttgcttcctcttcatctctccccttccgaccctacaggtctctagatctgttctggcctagcatgggaagtcttgcccttgctcagtattcttccaggcctttgatctcttccttatcttcattctgcttataattgatgtcttccctgggcggtgaatgctgctcaatcttgctattgcttgaaggggtggagactacaacagatgaaaaggaaaaccagagggaaaaaaaccttggttatttcggaacattattctgccacttacccttctaagtctaataaaatcctgcttttcaggcccatcttgtttatcagctccttttagcaacctgcccacagctactgatctctctcatggtaggagataagcacttcctctcgtgtgttccctgggcgttttgtttgtgtcctccatcctgaaccttgtccatgggtatcatgtcaccttttgaattgttgttccagactttcaattgttgggtccttgagatcacagggaccactgcttcttcagaggtgttttgtttttgtctcagctagggctgccataacaaaatacaacagactgtgtgacttaaacaacagaaatttatttctcgcagttccggaggctggcaagtaagagcagggcacttacaaagtagattttattctgaggcctcttctcttggcttttaggtggcctctagctcactgtgtgctcacatgacctcttctgtctgtgtacttggagaaggaaagagagcaaattctctggtgtgtcttacaagggcactaatcccatgatgagggccccaccttcataacttcatccaacctcatctaaacctaattacctcctagaagccccatctctagttaccatcacagtgggggtcaaggtttcatatatgaattttggaatgacacaaatgttcaatccataacagttttgttttgttttcctttgttttcatctctggcatttatgatggtgccagttataatggagaacagtaaatgcttaatcagtgaaagtattaagcatattcacctagacaagaaatccttcctattcctgtcaataaggttcaaggctctccaatgagaaattagattgttcagctctaatgtttgtcaaaacagaagttaatactttcacatactccatagttttgcttttaagcctttttgatgtcataagaaatatagaaaattatatttgttaacaatgaggctgctaatggccaggggtgagtactagagctttgcatctctctgctacattcagttccagcttccgcacctcctagaccctgactggtatcagctggcagaggggaatagttgtaacctatttgatcatgttttgctttctaatatagagaatagagattgattatgcttttaaaaattatggaaaaccatagttattcaacagaaaaaaacctgtaaaaaatgtggcatgtgactttctaatactgcttttgttgttgttgctatttagttcttaagtctgtgggccccacaaaatttatgcccttacacctatacacataactctggtatgtgttcagcacaattaggaaggacagatgtgtgtccgaatgtcatatgactcgaggcagtgtttcttagaatgtggtttgaaggccaccttgattgtggtaacctggattgcttgttacaaatgaagtttttccagcccaggcagtgacacacacctgttgtcccagctacccaggaggctaaggcaggaggattacctgagcctgggagttgaaggctgtagtgtgttgtgatggtgcttgtgaataatcactgcactacagcctgagcaacatagcgaccaccccatctctaaacaaaacaacaaaaaaatgcttttcaagagttttagaataagactcttccatgatgaggcctgaaaatctgcatttgtaataagttaccaggatgctttttatgtaccctagactttatgaatcattgctctatgtggtgcagaaagacagtagcaatgttctgcagtattcttccaatcttcttgatttcttctgggccaagacattttggattatggatccaatttagttattactggatcattctgtttttttattttctgtatatttctaacattaattatggtgttctcctctctcacacacacacatacatgcacatacacacattctagctgtatctaaaaatatatctatctattactttcaaatttgtaaatatatttttgcatctctttaggatttttaaaaaatgacatcaattgaatctataaaaatcttccactttttaaaatgcgtgccttttttcttaagctttgttcaagttttatctattttattgatattttcaaaaaccaagcttatggttttgttgactatctctacttttattctaattaatattttatcttcttattatttattttcttctacctaatatgtttatatttttatctttacttggcttttaaattaaattatcttattttagttttgttttgtagatacaattaagtctaaatttacctttaagtatcaccgtagctgctttccaacaaattttagcatatagtgcttttcactgtcatttagtcctaaacagttaataatttctattttaattccttgaattaatttagaagtgcatttaaaatttcttaaacatatggtttttttgctactttttaattattgatttctaatttaataatattggataaaaaatgtaatatgtctaaaatgtctttattttgcctgcaatcttgcataatataataggttgacagggtataaaattctaggttaatacttatacttccttaacaccttgaaaatatcatttcattgtttcttaccatctgttgtaaccagtaagaagtttattgtcagtccattattctaatgtagataatttgtattttctccttctactagactttaagattctccagtttcattacaatatatattcatctaggtttaaccttatatatttgatccttattttttctacttagtactttgtactttcaacctaatgacttatgtatttctttaattctggaaaattctcagcaatacttttcatatacttttactatttccttcattcgctttttctggaagatttgttggaggtcttttctgtagcatgaatattacatcataattttaagccttatctttctgtgctgcattctgggtaagttccttagtttttgttaccccttcattaattcaccctttgatcccagtttaaagttatcccatttattgtatcttttaattgcagtaactgtatttttttttttttttttttttgagacggagtctagctctgtcgcccaggctggagtgcagtggcgtgatcgcggctcactgcaagctccgcctcccgggttcacgccgttctcctgcctcagcctcccaagtagctgggactacaggcacccaccaccacgcccagctaattttttgtatttttagtagagacggggtttcaccgtgttagccaggttggtctcgatcttctgaccccatgatccgcccgccttggcctcccaaagtggcgggattacaggcgtgagccacagcgcccggccagtgattgtatttttttcagttttaagctttgtgtttttcatctttacctattcttatttcacttctgactgtgtatattttatgaattcattgtttttattgacggttttgtctttattaatttctggtcattgttagcatattcttttaatacctttgtcagattgtttcataaagttaattttatctaaagtgcatttatgttcaaattgttgattttattaattgccttttatttgtacctgcccagtgtcttgatttttgttccgtttctggttcacaaaaaatgtttgcttgtatttgtccttggcatcatttttactccccaaccttatttttttaatccatcattggtatgtatttagagtggactttcctgcttgaactcattgtgcatcttgaactgagagtcccaaacagcctggttgagtaagaggggaaaataaaaaaaaaattttttggagttgtctgtcattcaatagtttttaatgtcaattaggacaaaagcaaccttttctttccttacatccatgttggtactcatggctctgaaaagtttactttgaattaacttgaagctattcttatttagattggcttaatcttagaactgtttggctgttacttataatttacttcctaatgcaatatactaccataaacattgaaaagtatggttttttggagggaaaagataacagtgagactggcgatgtttgagtgccaaaagatattacttaaagacttccccagtgaatacttgtatgaaagctttctgtgatctagtctggatatgatggtgctccctcagccagaacctctgcttaattcccctctccctttcactcaacacatattttattgagcacctattatatgccaggcactgctctatgcactggatatatgacagcagacagatcatataaaatctctaccctcttggaacctacattccagcttattgttaataatagctttgctcagagagggtttttattaatcactgaaacactgaagaaagtataattctaggattgtttattttacaaagtattggtaggaaaagtaaagtgatgattctaggatctgcttttgttatctttcaacccaggaagtatatctaggggaagccacttttattcttattacatttctagaaacctgccacaagaaatcctaaccacatacatatatacttgtgtttctctattttcgatagtaaatctatgctggtggaagactatcagttattctaatgttattgttatggatttaagataaaataagcacaggagaagactgataatctgttttatttgtctatcaatcaaaggtgccagttttagaaaacatgttcacttcttccagctttgaaaacaaagttaaactaaagcaatgaaagggaagcacattgtcagtttaaacctcaaagttacattttaaaacataatcaaagaaggggcccatatttaattagatacaagatacagattagagtttctctcattaattaggtagctgtgtgagaaatcactcttaaaagcagttttagggtattagttttcactgacttacacattttgttctgatctgctgctgtgattaatgaatttttgagcaatgacgattaggttaatttgagttcattattcaaataccagcgcctaacagatggaacactaaactgaaggtcaggaaatgtgaattccactctaggctcacagctgactttccatgcaatttgaatttcttctgctttgtgaagatatttgtggattaatgttactgtaaataaaatgctctaaatgacaaggatataaagtactatgaaagcaaatgggaaaaaatgataacttaggataaagagtctctcttcatctgggaataatatttagaattcataaacaaccttttaggggaaaatttagatgctgtacaggtggcagaattgcttttttttacttgactttaaaataataatacctgatacttgaatagtgatttccaggtttttaaacactttcttgtcctactcttatgtgaaccttagaaaagccctgtaagttagaccattattctctgtggcctcatgtggaaaatagacaataatctgatttcctggagagattaagagagattagacatatatatgttgtccttcaaacctgatgccattttagagttctccatgtaagaagttcctgtcattcttacctagcctcatatcttcacatagttcagaaataacgtgttttctcaagcatataacttggtcttcttattttccttaggccttcaaaatgcattgtcgacttgttttcttctgaagaactgttcctgtaaacagctcctagcatttattgcagactagcagagcagtaaaagaactgcagttatttcaggctaagaatctacctcccctcactgactgtcttttgaggacttggatataaatctgattctgtcttgtaaccaaaatatgagttgctttgattttgtgaaatacaagagcacactcagtgttcaaactattccacaaagagaaaatatattatctgtgttactatctagtgttcactaagaatccaagctaagtcaaaaggccaggtatggttggcatttactgtgaatttatgaatcatccatgattttgttgctgctgcttcttattccatacttggccattgccagcaatgggactttatacaggtgagttggctgagtttcagtacaatgctctgtttaattgtaaacatatatgcactgggtataaatagggtggtgttttgtaccaggtatttttttcaggtaaccaggtcaataataaattattgagtgatatactgtgatgtttttcagtttgtggattaatttcacaaactgcatggaagcaaaaagccttgctctgttataactcaaacaaaagcccacagaaggagagaaaggatgctgcaaaggctggagccagccagtttgaaccggcactagttagtagtgacacagagaaaagaggtgggaccagcacaggaaggaggagcattcacactcagaggggaattacattcagccactgcctcatttctcaggttcactgtaaaggccatttagaggatgtaatttaactgtgtggttataggcctaatgttttcacaaacttcttattcttctgtgaaggagacacagaagtagctgtttgtgctacagcagtgctttttgcatttcccctcctgagatttgcttttttcccccctcccatttagaactgaatgtggatactggtaaaatagcatccttagttttggacatttcctgagaaaaaaatgaaaacaaaaccagcttttagagaatttctaagatcatggcaaggaaaagtacttaaaaaaaaaaaagtctaagcagataacaccatccaaagcaaataaaactccttcaaaacgatatctagttacaatattgtagaatgtgcataaagaaactccatttgctctaaataaatagagacaggatatcttttataacacctggtgaaaattaaagttacaaaagactttcttaagtaaaggcagtcaaattgattaacattatatgatcagtcatgtgaatatttaaaatacaaatagccattttttaaaatgagaatgacttttaagaatgagttaaattgagtgggcaagaaggtgattataggtcttctggtatctttcaagctcatcattgtcaaatcagttctgtctcattaatttcagggtttactactactaggcagcaatccaaaactatttaaaacctgctggatggttttcactctaggagtcactgccaaccccatcccccaaccaaaaatacagggactggagacaaaactgggagaaatgtttaacacaaacactctgccatgcagacatccttaggaatttgaagattcagcaactttagggtagattctcaccagttgagttcaggtgcatatgaaataaaacccacagctaagttaggcgtgtatgttgatgtttcatttagtagatgctatccagaattaactcataatattgtaatgactttggaagtcaatatgtgatgatacaattgattttaaattttccgtggtaattgtagtcatgaaaaacctgaataatctaataatcttattttagacatcggtttcaatttttcttctcacaaagccttatattggagcaatttgcaagaaaaccatgttctttattcctcctcactctttggtagatacccatggggtaaggaattgtccagaaataagaggttgtacaagaagcctatcttatctaaaccaaaagtgaataatttgcattgttaactagccactttttcttagttgtcgactcattgacaccgtacattggccaaatattttatgaaagctaatctgtactgtagcttcagagtgctaagatgatagcaagtgagtttatgatgatcccataatctttgaagaaacttatgtactggacaataaactaacaatgccaggtagtaatcaattaagaaaactcttaagaggcagacacaataaggagttaattctggaaaaacagtggactaggtgtatttggaaaaggctataacttgagttattccctggaagaggggtcccattggctgaaaggagagaggagagggaatagtatgaaatagttatggaagattggagagtttctcagggttaatagtgggttctgagtttgagactagtgagaagcttaagtttacagatacagtggggtcaggttaaagattgtaaagttaatctttttctagatcagggattaaaaacccaaatgccttctggggccagagaagctacttcagcgaggctctagggactggcaaaaggggtggtaacaggtgaatatgtgccctaagaggaagccattatttacctccacctaatcattccttatggcaaggacttcttatttttcaagagaaattgattatctgaacgattgtgtgaagtacctggatttttaaaacactaggcaaatcaaacaaaacccattttgaggcagattttaaactacacccataactatgtaggaaaagggagtcttggagctttttagtcaggccagagataatgatgaatactttaggaaggttatcacagtggttacctattggtgattttgaatggaaaagacctgtggacccaagtcatagactccaggaagccttttctgccccttctgcaatgaagagttaggaagacatttaaataagtaatcagcaagatttgatgactgactaaactggctgtcacatgtgttctttagggtgctttggctagggggacagattgtagttctttaaagctggcctttccctgtctctcataaaagtattttttgtccacaatatctgcaccacctgcctctagccagtggtggtgcctctacaacttcacttgtaattgctcagaaaattgaacagtaaggggtgggtgggtgggttggttagttcttaaggttcttctgagatatgggatgtagtgagaaaagctttaaccactcatcttacaatcagaagacttggaatcaagtcccaattttgctacttcctggccttatgaccttggacagatcacacaccttcttgaacctggcacattcttccttatcttggggctgtggcacaagctgtgttccctgacctgcataatctctctcttcacctttacctgaccctcaccttcttgtccttaagatcacagctaaaatgtcacttcctcagagaggccttccatgaccttcccatctaaagtggagcttctatcagtttccttgggctaatgtaacaaattaccgtaaactgggtggttacatgtccaaattcaagatgtttccagcagcatcctccatctaaaaagtagggaagaatccttcctggcctccttctagctgctggtggttcccagcaatccttagtgtgccttggcttgcagctgcaacattcctaccccttcctttgtggtcacatggccttcttccctgtgtgtgtctgggtctcttcacatggccttcttataagaacatcagtcattggatttagaacccacctcacttctgcaagacctcattttatctaatgacgtctgcaaagattctatttccaaataaagtcaacttctaaggttccaggtatacatgaattgaggtgtagggggggcactattcaacccagtaccaaccccctttttaaattatctttattgtatttactatatttgtagttatatattaatttgttggtttatctttctaacatgggaattctatgaaggcaagctttaagtccattttattcatttctatatactcaatgcctggataatttttgatacctaaaagctaaccaaaaagtatttatttagtacattaagtaatcttttttccctctggctaattgtcttcattgatgaaataatggggttggaattgctagtctttaaggtattttgcagttccagtagtatgtgactctgttttttacagatgcccagtgaccccaagttgctctgtgaatcagggcagcaggcatttacatgtatacatttttttattatgatgattgtactgtaccttccctttaggtcctacttgaagaaaaagaggaaaaaataaacacatgacattgaaataccaattggtttgcctggttttgaagagagaattataaaagagataaccaaggttgtatattctgattaagtatagtaaacactcattctgtgttatgtagtaaatacactagagattatataaactggaccccaaatctaaatgtatgtcaagcagtattcacttttatgctcagactggctggtacccaaaacacctttatacctcaaatattttttctcccataggagtataatataactcattttaatttaagaagatgtaggatgattatttctcatggaagttaatttattagttcgaattatttaattgacaaactgttggaaacatgtcatcaattttgacacttttcacagtacagtgttgctgaaactcctctttgggacctttaaatgctgtcaagaagaaaaatccatttaattttattgctgagaaaatgggaagtccttttgattaaacatgattttgtttgtatttaattcaggaatatttactttttaaaattaaattccaaaatttctaagcacttaaaagatgactctgtggttaaatcgaaaataattgactatattaatatttttaggccatgactaaacaaaaagcttgtctgtaaacatattttatcttactagaaatatcaccaacacaatcatggttatagtgttgattacagatgccttcagttcaattcaacatatgtttataaatccaggccctctttaaatcctgaggttaaaaaagcaaaaccacagggcacttcatggctaatgaactgaatttcttcctattccaaaaacagattttttttttttgttcttctctgttctctttaatattctaaactggttacttcaataacgagagaggaagactgagcccaccaaaactaggaggaggcaagaccacttatttcccaccttcccaatcaagtaagctgtggttcaagcagggcttcagagggtagcagggctcctgggcctctaagggatgctcagtcacatggacttgaccaacactgagggcattggtgagagacttccataggagggcattggccaatccagggcttgttttcaacacagcagattactatcttggggccaaaagactaaaatcaaactccactgagggagggtactagatgagaaagggagcagtggatgatacctaatgccttcatcctacagatatttattgaacacctactctgatgcagagcttgtgctgggtgctgaagttatcataaagaaatataatagtttcagccagacatagtggctcactcctgtaatcccagcaccctgcaaggctgaggcagatagatcacttgagcccaggagattgagaagagcatggcgaaaccctgtctctacaaaaaatacaaaaatttggtgggacatggtggtgtgtgcctgtagtcccagctactctggaggctgagatgggaggagcacttgaccccaggaggtagaggttgcagtgagacaagatcttgccactgtactctatctagcctgggtgacagagtgagaccctttctcaaaaaaaagaagggaaggagggagggagggacaattagcagacttatacaataagaagtaatacaaggaatatgatcaaggattatcttccgaaggaaatgacgtttgaactgagacaaataagatggacaagaaccacctagaaggagaatatcccaggcaaagggaagagcacgtgcaaagaatctaaaacaagaaagggcttggtttgttcaagaaaatgaagggaccgcagtgccgcagctgagtgagtaatgggcacagtggtatagatgatgaggtgacagagtagatagggcaagatcatatagggcattgcaagatcatggtaaggctttttaattacattgtaagaatcactccattagtggagatggacaggtagaactttggcaaaagataacataatgaattgagatttgaacataatcattttgcaatatctgtgtggctatacttattggttggatttttttttaatttaattttaagtttcaggatacatgtgcaggacacgtaggtttgttacgtaggtaaacgtgtgctatggtggtttgctacacttatcaacccatcatctaggtattaagccccacatgcattagctatttatcctgatgctctccctccccccactccccacacacaacaggccccagtgtgtgttgttcccctccctgtgtccatgtgttctcattgttcagttcccatttataagtgagaacatgcggtgtttggttttctgtccctgtgttagtttgctgaggataatggcttctagctacatccatgtccccgaaaaggacatgatctcattcctttttatggctgcatagtatttcatggtatatatgtaccacattttctttatccagtctatcattgatggacatttgggttgattccatgtcttcgcaattgtgaatagtgctgcagtgaacatatgcgtgcatgtatctttataatagaatgatttatattcctatggatatatacccaaaaatgggattgctgcttcagatggtatttctggttctaggtctttgaggaatcaccacactgtcttccacaattgttgaattattacattcccactaaatgtaaattattacattcccactaacagtgcaaaagtgttcatatttctccatagccttgccagcattggttgtttcttgacttttaataattgccattctgactggcatgagacggtatctcattgtgattttgatttgcatttctctaacaatcagtgatatcgagctttttcttcatatgtttgttggccacataaatgtcttcttttgagaagtgtctgttcgtgtcctttgctcactttttaatggggttttttttctcgtaaatttgttcaaattccttgtatattctggatattacgtctttgtcagacagatagattgcaaaaattttctcccattctgtagggtttagtttaattagatcccatttttcaatttttgcttttgttctaatttttttatgttttcatcatgaaatccttgatgagtggattattttaaatgttgatgtgattctcaggaagaagttgaaacgaaaatacaggtgtagacggcattagagtattgatggatgaaagtggggatataaaagacatatgaaagaaggcccagaacaccaatatttaagggaggtaggaggaagagaaagcaggtcctgaaatagggtgaggaaggtcagtacaggcactctacctaaaagtcttatcaaacaaaggtatgtttatcctccaggcacagagaataatttttcagagtgaaacgagaatccacatgtcctatctccctatatcatcaatcattgatgttattttatggcataatgacattaatatgtagtttaaataaacatgatattgagcaacaagtattataaaatgcagatgagttttaaaagattcaatgtgacacacacactcacatgtaaacacaaaagaagtctttggcaaagatgtagccccagacttcccaggagaactcagacattcatatcctttccttacaaaggtgcttgagcagaaatgtttgagatatactaaatgaattatgacttattctatgcagctactccacaaggcagatataattaacttgattttaaagctatcactaatgaagttcagaaagttaagtaacttccctgacattattctgttagttactaggtgatattagaatttgaatccaggagtctggttccaaagtctgaaatttttatgttttataaggaggtgagctaggagcaagcaagtataaagaaagaggacatggtcagtaatataaaataccaagcagtgcgagtaggatgaggactaaaaggttatcttggccttaggtgaccacggaacctaagttaaagaacattgaagtatgttgtataccacaatgatatacaactgttcaccaactagaatggctaagattaagaagaacaaacagtggataacataagtgttaccagtaggaatatctgcttaacgtataaacacatggtatcctatgacccttcaactttattcctaggtaaatacccaagagaaatgtcccatagaaaacaagtagggatggtccttgacttacaatggggttacatcccaataaacctataagtttaaaatgcattaaatataccttacctgtcaaacatcatagcctaacctagcctaccttaaacaagctctgacacttacattagcctacagttgcacaaaatcatctaacgcaaagtctattttataataaagtgtttaacatctcaaatagttgattaagtattgtactaaaagtggaaaacagaatggttgtgtgagtactccaagcacagtttctactgaatatgtatcacttttgcaccatcatgaagtcagaaaattgtaagtcaaacatcataagtcggggccgtctgtgtataaaatatttattgcagctttattaacactagcatgaaatagtaaacaactcaggtgtccatcagaagtagaatggatacattttcctgtattcattcaatggaatactatacgacaataaaaaaagtgaaatattgctacatgcaacagtatgggttaatctcacagatacttgttaagagaaaccgggcaggaaatagcacatactacatggttccatttatatgaagttcatgaataggcaaaattaatgatgatgatgcaagtatacatgaatactttaggtttcagggtaatgagagagccttgcaaggtgttagaaaagttctataccatgatctggtttgtgggtctatactttatatgggtctgtgtgtaaactttaactataatttaaggtgagtgcaccctactgtgtgtatgttaaacttccatctaaaaaatttttaaggtgatgataaagggaaatcccaggtagaaattgttttaacaacttttctgttatgaccttataaaactattcgatcttgcaaatcatgtagtacatgtattcctcttgatgactataaaattaaaaatgaatggggaattagtaagaaacattatagatatagatgttagaggtaataaatggaagagcaagttccagaataagttactgaaaggacaggtggtgggaaaaatagaaagaggacatcaccttcccactacagggaaattctctaggggctttttgcataacagagtgcccttgcacataatggctagatttggttagagtctaatgcaagtattctgaaatgcttttgaatgataagccagaaagaagcaaaaaaaataaaattatagaatgttagagctgtaagacaaggtatattacatttcatccagcccaaccctcttattttaaaatggactgtgtgcattgactctttggaagtgactcagtacagtacagagtgctctgatgtggtgtttctttgacaaggaaggatgcctttactgaagttttgttaatcatttccagaataatgcatgttaaacatgaactttgtacaatggtttgtccatgatccctatcagcatcttaacaattgaatgtttctgaatgtcggagaactggagatacattcattaaaatgtggtacccatttcaatgaaaaatgtagtaatgaacagactttaaagtaccatgccacatcttaaactgcatttatctcctggatgaaaaggaatgtcttattcccactttaagatatattagtatatctctcttagtgtatgtatattgctatatatcaatgcaattacactgttcactgtggagaggaagtattccaggtgagaaataatagtggaaaggggtaaggatggacatatttaagaactattttatttatttatttttgagatggagtctcgctctgtcatccatgctggagtgcagtggggtgatctcggctcactgcaacctctgcctccccagttcaagagattcttgtgcctcagcctcccgagtagctgggattacaggtgcccgtcaccatgcccagctaatttttgtattttgagtagagacaggattttgccctgttggtcaggctggtctcgaactcatgacctcaggtgatccacccaccttggcctcccaaagtgctgggattacaggcatgagccactgcgcccaggctttaagaactattttaaaaatataactgatagaatttgagaaccaattatacaggataaagaaaaaaagggagtcaaaattttgagtaacttaaaccattgagtgatgcacagatgctggagtagcgggagtactttagttgaaggggaacaaaatttcaacttggcaccttgtagtgagagcttaggcttgagtatttatctctgatcaacttgcataatagtaaatgaattataaataatgtttttctgttacctgtatctctctttcttcctatggatgatatggctaattaaaaaaacaatgatgaatatttcatattataggtcacaacaaagataagcctcgctcttcttttatatcctcattctcattttgcagagcaagcaattgtgttataaaatctgtggtgaaaacataaaaacaataggcaaaagggaagctggtatgtaactcatgccttgataatggcatttgctcatttttgcatctagatggtcctctctttccaagtaggaaacatttcattgctctgtaatgtcgtccgtatagcccacctcagtgctaggtagtttctgcctgctagggaagaactagtttaattggattgtagagaggcaataagaatgcttgttttccaaaactgaattggggacaagtcagcattctggatgattttttaagtaatacatgttttgaagttacctgtggtcatttattgaggaaagagtgaattacatttctgtaattattgtggattcttgaaaatagacaataggattttaatgatttcctgacatttttaagttttaaacctaataccgtatgaccatgacttaaatagagcctagtaactaaaattttattttatttttttcactgtttactcctaaaaactagcattttacttacattaatgcaatttctgttttattaggtgccagggctatcagtaattgacatgtactatagttaataatgtatttgttaaagtaaataacttttaatggggctaccaataagtgaatgtctccaattcaaacttaaattttaaatcataggtttgtaaatatttctaaataagttagaatactgcatataacaaatgtttattcaacaactatatagtaattatcagatcttagccaatatgctcagtactagagatatgtcaataaataagatccctgccctcaaagtgcttaaaatctgaactttgattcatgaaatccaagttataaagagttgacgctatttttaagatataaattatactgtatataaagctatattaatttttccagacaatagctaaattgccataatactgtcatgcaaatcagtgggaatactgataaagctcagttatttgtaattattgaagtaagaattttctctaaagactgaagactggaatttctacagatgtaaaataaataaaagttgtatgtggctgtccaaaacttcattatactatttatatttgcccatagtctgcattgtacttttaaaattctttctctctttttagtactggttgtcaccactgccaagatagtgcctccactgctaatttctatgacctgctgctaccacctccacctccctctgttttctctctgactttcttttgatttctgccacttctccagagaaaattcaccttcattcaaaacaactgattgtctatgggtgttcttaggcagttggcatgctcttttctttctgatcagccaattgtggaataccattagttatctttgtgcccttttcatctttatttctacttgctgttcaagagtactacctttgtgttaaaattcatttatgatggagggagggggtcatgataaacactggagtctgtggaaggatgggctatcttgacatctggagcattctggatacttgaagttgctgaaaggctgatctatagatatccaggacatgtaatatgattaaagtacagttgagcttccagaagtccttgtcttactccaaatattattttatgacttaggagaaccaaattttctgtttgggacttgaactcaggtgagctgtctgtatagatagtaataagtgaaaagtattcaaatctcctctaaaatttccgccattagattcggaagtgaacttttatgtagatcttgacttgtctctcttgatttgccttgttttcttccacacagtactcctttattttatttcctatttgctactggattgtctgtatcaggacatgtttttttaagataaccacttgaattttctgttgataattgttttgtcacctattttgtcagtgcgagaatataaattttagtgttcacataaaaggaaaaccagtttagtgattattcattgaaaagaccacaattttactcaccagtgaggttcattggttagcttggaccaagtgtacgggaacactggtattaacagaaatatttttgaaagccatgtgaaaaaatctcaattgcatctccattaattcaaagaactcatgatagcccttgtttgagtttcagaagttttcgtaaagcagcataatggcagcagagaatagcaaaaagagaactgagctgaggtcaggtaagcccaatgcaagttttgtcattggttagctgtcagacctttgttacctttgctatcacacagggacaataacattataagactattatagggattaaaatgaaataacctatctgtagaaatcacagaaagcctaccacactgtaagaatacaataaatgttgattacttccctcctcatttagttgagtcaaaatattactcagtgttcccacagcgttcaatattttaggacagttctggaatttatatgcttctttctccaattctggtaatactggatttttttgaaggatctagtttatttttatcagtttgcgagttttttgttttgttttgttttttaactgacctactcagataatgaagactcttaacaattcataaatgtcttgatatttcttctctaacagtcacacaaaataaaaacagctcttgaagaaaaacaattcaaagtttaaaacatataaaaatttaggtatttaatgtaatttgaagtaaaagtttgaattgaaaataattataaaactaatatgtgccatttctttgtaataattgttataattttcttgcataattcttaaaggggaaatggtgcaaagaacagcataatagtatggtaatggttgtagaaaatttatttcatttttcattccttaaaaatctagataaaagataggaactgttttctttaaaaacctgtaggcatgtgttttatttttaaatgttaatcaaatttatgctatactcctttattttaactatgccaatggactgatcaaataattaccaatagtgattaaaaaggactttctatatttaaacaaatattaaggtaactaaggggtaactcagctaacgtggctttttaatgataacaaaatatattagatatccacatgtcatgtaaaaccttgtgtaaaatattgggctgcttttcccagccttgctttttttttttttttttaacatcctatttataaagattaaaaagcctgtgggtgagagtgggggatgaaatttagtatcccttaaagcactttgctaatgctttgatttgtatatatgtgctcactaaatgttggatctgtatgggttagcatattttctattatacgttagaaaatactaattcacttttttaaatagctgaatgagatatgaaaagacagaactggtgagttagtagctgctgctttttaggcatgccatactatcaaaccaagatagaacattttaagtaaaaacatttgaacaaaatcctaaagacatataaaggaagtcactttatgaaaaatataactgcctttcaacatctttaccttttctcgtacttgctcaaattatgactatgatgcattatctataaacataaagtctaaaaagtataaacatttgatatatttgtgcatatgttgcattttcttttattatttctattcctagtataattcaatttaggccaaaatgttgagtttagtcatgattttatatttccataggttaacttgagacatgtaaacaagtaagttatttatgtgctatataatcctctacctactaggatatttacttaatagtagttttgtggcttaggaagcagagtaattaattagagtgaattaatggcacacactggttgctatgtttctgatttgctttggactgaatctttatgttcctcaaacattgtttctgccatttagcagttgcctaacagagtgatggtatttggagatggggcctttatttgggaggtaattaggtaatgacagtgaagccctcatgaccgagatttgtgcacttagaagaaaagaccagagagagctcgctttttctctctctgttctctgccatgtaaggacataatgagacgatgaccgtctgcaaaccaggaagtgggtcctcaccagacaccagatcttctggcactttgatcttggactttccatcctctagaaccatgataaataaacgtttgttgtttaagctacccagtctctgtaataacatttgtcataacagcccgaactgactcagacacatttcttcctcattgatgagcaaataaaccaaaatcataatatttttcttgctttctgtctgaaaataatgcatttcccaattttgtattccaaagacctgtatattttattgtctatacttctggcctgctgccccaaagcagagagtcctttatatgtttgtttattcaaacatcccaggccttctcaaaataacccccaacctgaaatagaatgtgatttaaaataacagaaccttggctctggaatcaggcatgtggcaagcacacagaatatatttgttgatggaatgaatgaatgattagataaaggaatgaaaagatctgatttgtaaaatgctctcatattgaaatactttccccctctttttttatctttttataggtcatgcaacacttttgtacttgggaaagtgttctaactaaagcaattatgcaataaaagtagtctttgatgttggcttctctgtcaactttatgttggataaaatatttgggaattctgctctgtagttaaaaatatacgtgtatgtagcagggaaatgataactctctcaataattaaggacaagcaatcatatcctcgatgtaaaatgggaggaataacaattttttttaatttataagaaacagctagtgtcactgcacttagagaaaacacattaatttcttttatgttgtcaggcagagaaagtataaactttggaggttgcacagtaaggttaggcaatggcctgtgagttaataaacactattgttagatttatatagaattttattagtcttgctcagtttctcttcaattccatctaacaaggtttcctttccagcttatatgtatgcttatctaagtccaaggaattccataagaaagttgaatcaaaatattttcaattgataacttatgaagcaaaaacagcaatttcccattatatatttcaaataagtttactgtacaattttgaagtgactgtagagtctgaattgtattcagactatgtatcagttgtattcagattctggccatgtatccactaccaaaataaaatgaaaaaatgaacatggttttgtcacaagttaattgttcaacaacaataatgacaacaacaaaattatctaaaatctgaattttctgagtaacgactcagtaccatcagtaaagtagtagaatacaaaccttagtgtgctatctatgtaaagaatttaattatgttcactccagatatagagactgttttgtttccacagaattcgtaaactgtcattacagaactgagaaatgtgactttgaaaatccaaatctacgtgtaaaatttagttcaacctttgtaatattcaaatgatcttgatgtttcagcttgatatttcagccagcctttgcactcgttgttcttccttcaaatgaaggtactttatgtacttctagagaatctcctatacaaacaggaagtatgagtatgtggctttagtgatttttggagtacatgctagcatcggtgattttaagtggttattttaagtattaaaagtggttagaagcacaggctttggagtcaacagacttggctcaagtcctgaatctgttgtatcttaggcataactgtgtgacatctgtggaaagagctgtaatgttaagatgctatcaataacagcaaatgttaagatttagtattgacagaatattcctgacaattaaatattctcttaagggactgagtagaaacactagtgaaaaagatgctagcccagaaaaaaaaaagtaaacatgctatgtgggcacaaggtaatgaagaaaagatacagaaaatgcaggaaactaagtatggcattattccaagtggcacatcatccaggcaatctctactaagcataattaagcaggaaaaaagtctttccttaggtctgtgcccttggcaaatgtatttacttttattaagcctcagtttccttctctatgcaataaaaaagaagtgatctctaaattgcatatattatttaaatatgatgaaataatatctctagggcctttagcacagtacctggcacatgaaaaccattcattaaatggtaactattattattgttgctgtatttcttataaaaataaattagtacttctttggctgtataccagatgaaaaagactagtcttggtgttaatgactcataaagatctgtttctcagaagatggctttttaaagaaaagagaaaaaataaaagcatattaaaatacctctataaaaattctgtagtgagggctaattttgcttcctttttctaatttcaactgtttatatatatatatatattacatatagtatatatataacatatatgtatatattttaactatatatgttatatattttacatatatgtatatataaatatatgtgtatatatattactatatgaagtttttcctagtatcaatctattttaaagataattaactattgaagaaaaaataatagcaaagtagtgtgaggtttgcaacatatataaaagtagaatatatgccaggagatcaggagagaaaatagtaaagtatgttattgtgaggttttcatgctatatatgaagtagtatactaccaaccaatgtctttcataaacatagatgcaaatattcttaatacaatgttagcaagtcaaaaggataatatatcacaacagaatgatagctatcccaataatgcaaggatgacttaaaattcaaaaattaatcaatgtaattaataacaaactaaaataaaaatattttttatttgggaggctgaagcaggtggatcacctgagctcaggattgcaagaccagcctaggcaacatgccaaagccctgactctacaaaaaaagaaaaaataaaaaaattagacaggccagtggtgcatgcctgtagtccccagctacttctgaggctgaggtgggaggattgcttgagtccaggaggatgaggctgcaatgagccaaaattgtgccactgtactctgtcctgggtgacagagccagaccttgtctcaaaaaaaaaaaaaaaaaaaagaaaagaaaagaaaaagggaaaaagaaaaagaaatattttggataatttcaatagggaaatataattaacaaaatttaatatcaattctcaataaactcccagcaaacagcaaagtaagaatagaaggaatggtcttaacctaataaaggtatctatgaaactatgtaactaacatcatacttctatttgtttgctagggctgccatagcaaagtaacacagactggatggctttaacaacactaattttctcacagtttggaggctagagtctgagttgaaggtgtcttcagggttgacttcattctgaggcctctctccttggcttttaggtggccatcatctccctttgtcttcacgtggtctttcttctgtgcatgtgcgtgtctgtgtccaaaattttcacctcttgtaaggataccaatcataatggattaggacccattctaaagacctcttcttaacttaattacctctttaaaaaccttatcttcaaatacagttacatactgaagtactggggtttgggacttcaacatgtgaatttggagaggaaacaatttagcccataacaatacttaatgctgaaaaactgaatgctttccccctaaaattagaaacaaaacaaagatgttcatttttgccacctctatttaatagtgtgtgtttatgtgtgtgtgcatatatttttcccagcaagtacaataggcaagataagacaattagagctttctaattagcaaataagtaaaaccctatttatatagagatgacatgatcctatatttaaaatacaatgttatctacaaaacagctcctcaaactaatgtgattctgtaactttacagggtacaagatcaatatataaaaataaattttatttctatgtgtcaggaaggaatgatcagaaactaaaatttaataaaaatatcaattacaataatatcaaacatataaaagaattaggggtaaatcttttttttttaatgtgtgaaggaggtatatgtggacaactacaaaacactgctgagagaagctagagaagacctaaataaatggagaaagacactgtattcatgagatgcaagagtggatattgttaatatgtcagttctccccagattgaaattcagctttcttttgtagaaattgactacctcatcataaaagtcatatggaaatgcaaatgactaagagtaaccaaaacaactttggaaaagaataaattagaacctaacactacccttttcaagaaatatagctacagtaacctagatgatgtagtattggtgtaaacatagacaaatagatcaagggaacagattagagagtccagaaatagactcccacatatataggcaagtatccaaaggcaatttactggaggaaagatgagtctttcaacaaatggtgctgaaaaaaattggtacattattttggaaaaaaatcaaaataattatgctgagtgaaacaaactagacacaaaagagcacatatgcctatatttatataaaatttaatagatgcaaactaatgtattagaaatagatcagtgtctgggcgcagtggctcacgcctgtaatcccagcactttgggaggctaaggtgggcagatcacgaggtcaggagatcaagaccatcctggctaacacggtgaaaccccgtctctactaaaaatacaaaaaattagctgggcatggtggcgggcacctgtagtcccagctactcgggaggctgaggcaggagaatggcgtgaacccaggaggtggagcttgcagtgagccgagatcgcgccactgcactccagcctgggtgacagaccgagactcatctcaaaaaaaaaaaaaaaacaaaaaacagatcagtgtatgcctagggtggtaggggtggtggtggtgcagagaggtactacaaaaggcaggagaaaacttttggggctgatgcatgggttcattattttcattgtgatgatggcttcacaggtgcaaaaacctattaagtcaaatactctaaatgtgcaccttttattgtctgtcaatcatacatcaataaagctgttttttaaacaaacacctactatgttcaaactcgatagaattccgtacaggatgcttgccgtgttctcttttttacaaaaatgtactttaaaataattataagaatggataggatcaaattgtttttaagaacttgacagttttcgaagacattaaaattaattttatttaaaacgagatttataagaaaaattattacaataaaatcttattttaaaaattcagaggaggaaaagtttgtttatgattgaaaggaataaccaggtattaaaaagtaggaaagtctaggaatctgccgtgatcagagtaagcaggtagaatttccagttattcatgacagagttctaccacgttttgaaaggtaaacatgagttcaacctgggaagatgagaaaaagaaattctagataaaaggaagaggaagaacaaaggcaagagtcaagacatgaagaagtatgtttagggaatagcagtaaatgcatttggatagaatggtgtacgaagagtcttatggaagataaacttagcaagagaaagtggggcagatgggacttgggttttctctctgaaaatttctttgaatccccacaagcagcgctaatactctcattctcctaatactctgcattctcctaatattttgctccataccctgctacaatacttgtcacattttattgtatcatgtgtctagcttcacccttaggcacccgtctattagaaagaactacatttggctcattataaatgctcgataacaaaatgctcccactttaaaaaataggatagtctaggtatctgccatgatcagagtaagcaggtagaatttgagctggtcctttaaaaactgactagttttggccgcgcgcagcggttcacgcctgtaatcccagcactttgggaggccgaagcgggcggatcatgaggtcaggagagcgagaccatcctggctaacacgatgaaaacccgtctctactaaaaatacaaaaaatggtggcacgccctgtagttccagctactccggaggctgaggcaggagattcgcttgaacccgggaggcggaggttacagtgagccaagatcgtgctactgcactccagcctgggtgacagagggagactccgtctcaaaaaaaaaaaaaaaaaaaagggggggtggcggtcatttcaagaataattttatagggaaaggagtgagagtatccgtagtaaactgagggaggagggtgtatatattaaggagcactgagaattgaggtttataggaaaactaatatttatcattagttgttatttagcccaagcaagcggggacacatgctgtatatttaagttttctaaaaagtatttactcttcatttccttcgttggctggcacagtagagctctaagcaatcagaataagcagagaattttataagtcattttaaaaagaatatctcaaatactttttgggggaactatatttatttttcttttctcttaagttgtgtatatgttatataaaaatggaattgagaatagtattatatttgctcttggcattatatttgattgtcattatgagcctgtggtgggccatggagtaaaacgaattgagaaacagtgacctagaatgttagcacttcgagaggggactgtgctcgatttagctttgtaggcagtagcatggtgctcaagaaagaatgctgctcctgcaaatcaggataccagaatttgaatcccaatttaaatttaaaacttgtttaaggacctttaaacatgttaattatcctatagttcttccttcgttatttactaaattgggatacaaacaataatagtttcacatcattaatatgtgagttatacacaaaagaacgagggaaaacatgtagcgccatgctggtatacagcagttttctgtaatcatgtacttcatcttgcccagcacaatactttgtagatagagggtacttaagcactcattcatactgaataaatcaatgtatgaacaactgagaacctttgaaaaattccttttttctgttcatgttcaacttaatgctttcagagaactgactgtgaaaataaccttttttctggtaatctctatgtgtttgaataaaagaacaatggtgaagctccatctatttttaggttatgtagccttaaaaatgagaaagctaaatatgctgggagattttatttattttgttttcttggtctcattttatttctgtcttaaattaagttaatgaaattttgggtaggcctggtcacatttaatacctagttctccaagtattttttgtgcatcccttttatagcagtgtgcaatgtgacagctcagcctcctcttgctgactaatctcctgtacagacagaagcaattcccataattcagataataacctggaacaactttcatgatttacaaaagtagatttgtaactgatcttcttataatttagaaaaggagattagagtgtaataaaatatcaaatcatagcttaggaatagaattttggatgttaaaactattctgaaagtaaatacagttttaaacaagaacctgtactgatttaattgcttcaaagaaaacatattgaaaaagaaaagaattatttaagttagcatatacttataaatagtttcatagaatgtttaaagctaaacatattcaattataatttggattacactattctattacataacaacctacataagttgattagaacaaaactacgaagtaaacttcaacacaatccatataatagaatctgaattagaaaggcttgaatttattgtatgtaaatttatgaagactttatggaaatagatgcacctttgtaaaaagacagaacatgaaatgttaaaatgattgcttttttatcctttatttatttatttttgctaaaccataccatactcttaagtcatagttccagtgcttagtgcatagaaggtgttcaaggaataattgtggaatttaggaaggtttaatttctgacctataataaaggtcagaataaatggtaaaattagacaaaaaagtcaaggaaaatataagcataatctctaataattcaaaagctatgttgtggtgcattctagaaaggtgaatttgtggactttttttttaagggaactcatttgtatcagattgtcaggaaataatgttacataaatttctattttctgctttaaatgctggcatgcgttctttttaatagtgtgtattacaaatgcaccaaatctagggctaagtaaacagaaagttgaatcaaggtacttctcattttaaaaattgttctggagtcttggagtagaaagggactttggagttgatttttcccaacttccttctattattgatgagggaagtagaaggggaaaatgactcgttcactgtctgtagcttgaaaaaaaagattttttaaaaatctatacttgatcaggcaggcacaggaaggtacttaatgaatagtttccaagaagagtcacttcggcataagagatacatattgtagattaatttacaggcaatatcaattatagtaataaattattggtgattattaataattattaattttaaattagcatgttgggtcttatgtaattgactgaggaatcaggttaaggtgcatctttcattgtgaaattgagattttgggaacatgcaaagcctcactgcagatcctaatgaatttaccacagggatgctgccctaccaatacacttgagtagaaattttcaaggggagttgagggacatgtccttggtaacaagaggattggggaagggtatatttcacttgaaatttaaacaacattttgttccatggtcttatttatttttgggcacattattgtttttttaataaattcaaatagcattaaaagcattcatgttttctttttaaaagttaagaggttttaaggcataagtcaactagttttttcctctgtccttttggaataaatcattcattcttttaataaacgcttattgatcatctctatattccaggcatagtggtaccctctgaaaatacagtcaaaaagttgattcctgtctataagggggagccagagtttattcattgagaatttacagcagaatattattgctccaagtttccccctgccatctacactcatcattgcaatatttgacacagtagtcatttattggagaaaatacaaaaagatagaaatcacaaagagtctttcacttcacttgctcattactcagcaagtatttattgagtacctatcatgtgccagtcactgagctaggtgcttgggttccattagtgagtaaaacagtcaacgatcctgtctttgcagggattatattctaggaggtgagactaatagccaaaaaaaaaaaaaaatgcaaattacaaagcatgttagaaggtgatgtgtgctggttaaaaaagagagagagagagtgagagagaagtagagttaggggaattatgtgtgtgagaaggaaatttagtgtggtcaagagaggcctcattgtgacttttgaacaaaggcttgaaggcacttgaaataaaaatccaaaaattaggataaccatagaatttgaatttttaaactcattttaagtctattttgttatctatgttacttcctggcaagaggctgcaggtgatggtaaagtcaaggattttatttttctttcttttctctcccattagctttgattttcacaaggagtggcatttccactattttctactttgctaaaataaatgtatttcatgggatttttgttcatcaatgataagaacaaggtttactttgagaattttctcttgagagcctagagcaacatgtagcataatttcatatcatgcgctgtttcttagaaatataaaaatccatatattgccatttttagaatgactcttagtcatatcagtttgggcaagaagtcaacttactttcacatggaatcactgagtcatagatttagataagaaagcagtttactttcttaatattcttcatcgattttagcatattttaaaaatagaagtatctgtttcttacagattctgtttctggcgtctgcatacgcaagtccccaactcgctgaggagagctgttcagctatggctgctgtcacacattacctgtatctttgccagtttagctggatgctcattcaggttggtacctcattccctctccccgcccctttaatcttttaatgaatctgggtggagtggtcttaatgtctgatactctgtactgaagtagaagtaattccgtatatccatcactgcattctcaggatataaatgacaaataaaaacaccctataagctgtacaacagtagagagcattgtgagtttgaagaaatgatggaaatctagtaggattggaaacaagggagtggttagagatgaagtctgcaatgtgggccctttaaagcacagttggaaatttgaacatttttctaggaaaagtaatagaatgattttaagcaaaggagtgacatgataagatttagattttagaaagatctccctgtttgtagtgaatatgagacaggaaagagtggataggcaagccaattaagtagatttagctgtattcatggggaaatcatggtagcgtgaactaaggaggtggcagtagaagcaaagggaagtggactgttttggagatttttttaagctagaactataggatgtgaagacttgttgtggggaatgcagaagttggaacccaggatgcttcccaaatttctggccgggtatctggtggatagtggtaacagaaattacgatcactgaacaatggggaagagctggtgagtttcgtttgggacatgctgaatgtgaagtgcctatgagacttccagtgggaactttgaggagagggcgatacatttagaaatgcactgggaatgccagtgctttgggaggccaaggcaggcggatcacctgaggtcaggagttcaagaccagcctgtccaacatggtgaaaccccatctctactaaaaatattaaaaattagctgggcgtggtggtgggcacctataatcccagctactagggaggctgaggcaggagaatcacttgaacccaggaggcggaggttgcagtaagccgaaatggcaccattgcactccagcctgggcgagaaaagcgaaactctgccaaaaaaaaaaaaaaaaaaaatagaaagaaagaaagaaatgcactgggaagctattggcttagagttggaaaatggagccattggtttggaagagattacttggcgagaaggtacagagtgagaccagtagagtcctagcatactcccctgaggaactagtaaatgttgggggagaaatttcaattttccttttctaaataaaatcccaaattctctccattattctatgctgatttggtcgataaagaggctaagagaggaggatggtgcgtagtatttaagtggctcaactaaaatgctgcctttggtaatgcattctgtgtaatggtatttttaaggttttcatgtgatactgtttcatatgcatttctgagtatggatgtaaactattttaatgaaacagatgcattcaggcccttgcatattcttttttcttgttgaagaggaaggttgtgggacttgatgatgtagcaacagtgaattaatggtaaaaggagaaagaaagtgaggtggtggtattatgagagaataccacataccacacaggctcaaggaagggttgttttccccagtatgatatgatagtagtgggggctgaagaagagaactgaactatttagctaatagaactagttgaaacaagtggcaccctggatctggatttgaattctggctctgccactatctgtgtaagcttaatcaagctattgactctctccaagatttgtttctaaatctgcatatagggataataattcctaactcatagaattattattaatattttatagctctttgagcagttttaatcatggaaaattaatggtgttttcaagctcccctctcaaaaaaatttgcaaataaaagtgaatttaaaccatataacataaaacttacatatctgctgaaattagaataacatttgcgagattttctgattgcaaaattctgtaagagtttatctgagttaaacttttttaaatgtgccctatttatgttgttatctgtctgcctgtattgaggtccccagtgctatgctaaaggtctttgtccatgcccctgacctattcagaatttttgattcattacttggatgaaaacacaggaaattgcttatcagatatgtacgtggtacagaactgaaaggacagctgcaacagagagctgcctgcattaagattacaagtagagccaatgaagagaaactgtactgtgataaattaaaaactagagtgaaagagacatcatctgatggaagttaatgtaaattactcaaaattataatttaacataaactcagcagcaattgaatatgtgaccagaatgcttaacaataacaactactgtaactacaaaaacaacacacacctaggttgcgttgatagcagtatggaagcagacatgtttacgttgtaatttacaaaattcagactattttgggacatagcaaccactctcatgggtcgtgtttcagcaggaacattaattatccaatgagaagttggaaaacaaccccctaagaaactttgaggcagctggacataactaacctggaaagaatttaggtaaatgtgatggctgtctacaaataccggaagggctactgcaggaaagggtggactatgtagctccatttggcacaactcagagcaaatgggtcaaaaattagggaaggaaatttttgattcaggttaagagtgttcatagcaataaaactgtcaaagttgaagaggcttttctaaaagtagagtaaattcaatcactgaaatatatggagagggaaatgaccaactttcaaacatgttttagatggattttctgctttcaggggcattagacaaaatcatatataagatttcacccaagttaatgaagattggtatattctacatctcttctttgagttaggtaaatatgattgtgcctgattcacatttagtagaccaattagattctggatggctaatggcttaggaaagctatttaaagtaccagtgaagtttaatgtatttcagatggtacaccacacatttttcatggtttgtgatttgaccacaagggaaaaagtcagtcagttctgaattctagttaggttacttttaatgaattattttatgatcagaggttgcacttcaccaacctacatattcccatttataaaacagtgactgctgaaatctttttttttctaaaatccgttttaaaaacattatgtagaaggttagactattattagttcaatcctattagttgaattaggttgaataaaattgagagaagtttttactttaatgattctacttcatttttttagtaatataggagcgaatatgatactacatatgtctgtgcatagcttataatgacaataaattaatcattaatttgtaattactgagttaagcatgtcagaattgttaacgtttatttttatctgcgtatcttcagtcttagaataaatacattgaaatgactttatcttgaaaattattttacttttatatcctatacttttagtgccatataataaagttagattatattttagagtagcttagggaaaattttattggtaaacaagttacataacctctctgagccttgattttcttatttgaaaactcaagttgtaataacagtacctctctttacagactgtgaaaagacaaaatgaattaatgtatagaatgaacttgaaatggtgtctgggacagaatgcatactctgtacatatttacccatattatttgttaagataatatgttgtggctaaaatttcatagatttgaaaacatcttgaatactctgctattccaatataaatttataccttctttttaaccaaagaagatcatcttcatgtagtggaaagaggtccgactttgagtgaggtggacactaactagctgcaaagccttagcaagctggagaacctttaactccttattaaagtagatgcatggctcataacaggctccataaatagcagccttgcctctgtttcttcaggcttcccttttctttgacagagaagtcacacagtgcaaagcgaggatgtattaacaaattattttgcttattttttaaaaggaaacaattcataaattcctttcttggccatagatattgaattatccatctgtttgctcttcatgtaagatcactccttgaaactattgaaatcatttctcccttaagaaggcagggttggggcagttccaagatggccaaataggaatagctccagtctacagctcctagcgtgagcaacacagaagacgggtgatttctgcatttccaactgaggtactgggttcatctcacggggcctgatcggacagtggaggcaggacagtgggtgcaacccaccgagcgtgagccgaagcagggcgaggcatcgcctcaccagggaagtgcaagcgatcagggaattccctttcctagccaagggaaggggtgacggacagtacctggaaaatcggatcactcccaccctaatactgcgcttttccaatggtcttagcaaatggcacaacaggagattatatcccgtgcctggctcggagggtcccacgcccacggagcctcactcattgctagcacagcagtctgagatcgaagtgcaaggcagcagcgaggctgggggaggggtgcccaccatggctgaggtttgagtaggtaaacaaagcagcagggaagctcgtactgggtggagcccactgcagctcaaggaggcctgcctgcctctgcagactccacctctgggggcagggcatagccaaacaaaaggcagcagaaacctctgcagacttaagtgtccctgtctgacagttttgaagagagtagtggttctcccagcacagagtttgagatctgagaatggacagactgcctcctcaagtgggtctctgacccccaagtagcctaactgggaggcatcccccagtaggggcagactgacacctcacatggccgggtacccctgagacaaagcttccagaggaacgatgaggcagcaacatttgctgttcagcagcctctgctgctgatacccaggcaaacagggtctggagtggacctccagcaaactccagcagacctgcagctgagggtcctgactgttagaaggaaaactgacaaatagaaaggacatccacatcaaaaccccatctgtacgtcaccatcatcaaagaccaaaggtagataaaaccacaaagatggggaaaaaacacagcagaaaagctgaaaattctaaaagtcagagcacctctccccctccaaaggagcacagctcctcaccagcaacagaacaaagctagacggagaatgactttgacaagttgagagaagaaggcatgagatgatcaaacttctctgagctaaaggaggaagtttgaacccatcgcaaagaagctaaaaaccttgaaaaaagatttgacaaatggctagctacaataaccagtgtagagaagtccttaaatgacctgatggagctgaaaaccatggcacaagaactacgtgatgaatgcacaagcctccgtagccgatttgatcaactggaagaaagggtatcagtgatggaagatgaaatgaatgaaatgaagcaagaagagaagtttagagaaaaagagtaaaaagaaacaaagactccaagaaacatgggactatgtgaaaagaccaaatctacgtctgattggtgtacctgaaagtgatggggagaatggaaccaagttggaaaacactttgcaggatattatccaggaggacttccccaacttagcaaggcaggccaacattcaaattcaggaaatacagagaatgccacaaagatattcctcgagaaaagcaactcgaagacacataattgtcagattcaccaaagatgagatgaaggaaaaaatgttaaggggcagccagagagaaaggttgggttacccacaaagggaagcccatcagactaacagcagatctctccgcagaaactctacaagccagaagagagtggggaccaatattcaacattcttaaagaaaagaattttcaacccagaatttcatatccagccaaactaagctttgtaagtgaaggagaaataaaatcctttacagacaagcaaatgctgagagatttcgtcaccacgaggcctgccctacaaggggtcctgaaggaagcactaaacatggaaaggaacaactggtaccagccactgcaaaaacatgacaaattgtaaagaccatcgatgctaggaagaaactgcatcaactaacaagaaaaataatcagctaacatcataatgacaggatcagattcacacataacaatattaaccttaaatgtaaatgggctaaatgctccaattaaaagacacagactggcaaattggataaagactcaagacccatcagtgtgctgtattcaggagacccatctcatgggcagagacacacataggctaaaaataaagggatggaggaaaatctaccaagcaaatggaaaacaaaaaaaggcagaggttgccatcctagtctctgataaaacagactttagaccaataaagctcaaaagagacaaagaaggccattacataatggtaaagggatcaattcaacaagaagagctgactatcctaaatatatatgcaccgaatacaggagcacccagattcataaagcaagtccttagagacctacaaagagacttagactgccacacaataataatgggagactttaacaccccactgtcaacattagacagatcaatgagacagaaagttaacaaggatatccaggaattgaactcagctctgcaccaagcggatctaatagacatctacagaactctccaccccaaatcaacagattatacattcttctcagcaccacatcgcacttattccaaaattgaccacatagttggaagtaaagcactcctcagcaaatgtaaaagaacagaaattataataaactgtctctcagaccacagtgcaatcaaactagaactcaggattaagaaactcactcaaaagcgctcaactacatggaaactgaacaacctgctcctgaatgactactgggtaaataacgaagtgaaggcagaaataaagatgttctttgaaaccaacgagaacaaagacacaacataccagaatctctgggacacattcaaagcagtgtgtagagggaaatttatagcactaaatgcccacaagagaaagcaggaacgatctaaaattgacacgctaacatcacaattaaagaactagagaagcaagagcaaacacattcaaaagctagcagaagacaagaaataactaagatcagagcagaaatgaaggagatagagacacaaaaaaccctacaaaaaatcaatgaatccaagagctggttttttgaaaagatcaacaaaactgatagaccactagcaagactaataaagaagaaaagagagaagaatcaaatagatgcaataaaaattaataaaggggatatcaccaccgatcccacagaaatacagactaccatcagagaatactataaacacctctatgcaaataaactagaaaatctggaagaaatggataaattcctggacacataccccctcccaagactaaactaggaagaagttgaatccctgaatagaccaataacaggctctgaaattgaggcaataattaatagcctaccaaccaaaaaaagtccaggaccagatggattcacagtcgaattctaccagaggtacaaggaggagctggtaccattccttctgaaactattccaatcaacagaaaaagagggaatcctccctaactcattttatgaggccagcatcatcctgacaccaaagcctggcagagacacagcaaaaaaagacaattttagaccaatatccctgatgaacattgatgcaaaaatcctcaataaaatactgacaaaccgaatccagcagcacattaaaagcttatccaccatgatcaagtggacttcatccctgggatgcaaggctggttcaacatatgcaaatcagtaaacgtaatccagcatataaacagaaccaaagacaaaaaccacatgattatctcaacagatgcagaaaaggcctttgacaaaattcaacaattcttcatgctaaaaactctcaataagttaggtattgatgggatgtatctcaaaataataagagctctttatgacaaacctacaaccaatatcatactgaatgggcaaaaactggaagcattccctttgaaaagtggcacaagacagggatgccctctctcaccactcctattcaacatagtgttggaagttctggccagggcagtcaggcagaagaaagaaagaaagggtattcaattaggaaaagaggaagtcaaattgtccctgtttgcagatgacatgattgtctatttagaaaactgcattgtctcagcccaaaatctcaagctgataagcaacttcagcaaagtctcaggatagaaaatcagtgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggacacaaagaaatggaagaacattccatgctcatggataggaagaatcaatattgtaaaaatggccatactgcccaaggtaatttatagattcaatgccatccccatcaagctaccaatgactttcttcacagaattggaaaaaactactttaaagttcatatggaaccacgaaagagcctgcactgccaagacaatcttaagccaaaagaacaaagctagaggcatcacactacctgacttcaaactatagtacaaggctacattaaccaaaacagcatggtactggtaccaaaacagagatatagaccaatggaacagaacagagccctcagaaataataccacacgtctacaaccatctgatctttgacaaacctgagaaaaacaagcaatagggaaaggattccctatttaataaatggtgctgggaaaactggctagccatatgtagaaagctgaaactggatcccttccttacaccttatacaaaaagtaattcaagatggattaaagacttaaatattagacctaaaaccataaaaaccctagaagaaaacctaggcaataccattcaggacataagtatgggcaaggacttcatgtctaaaacaccaaaagcaatggcaaccaaagccgaaattgacaaatgggatctaattaaactaaagagcttctgcacagcaaaagaaactaccatcagagtgaacaggcaacctacagaatggtagaaaagttttgcaacctactcatctgacaaagggctaatatccagaatctacaaagcactcaaacaaatttacaagaaaaaaacaaacaaccccatcacaaagtgggcgaaggatatgaacagacacttctcaaaataagacatttatgcagccaacagacacatgaagaaatgctcataatcactggctatcagagaaatggaaatcaaaaccacaatgagataccatctcacaccagttagaatggtgatcattaagaagtcaggaaacaacaggtgctggagaggatgtcgagaaataggaacacttttacactgttggtgggactgtaaattagttcaaccattgtggaagacagtgtggcgattcctcaaggatctagaactagaaataccatttgacccagccatcccgttactgggtatatacccaaaggattataaatcatgctgctataaagacacatgcacgtgtatgtttattgtggcactattcacaatagcaaagacttggaactcacccaaatgtccatcagtgatagactggattaagaaaatgtggcacatatacaccatggaataccatgcagccataaaaaaggatgcgttcatgtcctttttagggacatggatgaagctggaggaaccatcattctcagcaaactgtcacaaggatgaaaaaccaaacaccgcatgttctcactcataggtaggaattgaacaatgagaacacttggacacagcaaggggaacatcacacaccggggcctgtcctggggtcgagggaggggttagggaaagcattaggagatatacctaatgtaaatgacgagttaatgggtgcagcacaccaagatggcacatgtatacataggtaacaaacctgcacattgtgcacatgtaccctagaacttaaaagtataataataaaaaaaaaataataaggcagggttatatctactttaagaaaaattgacagtaagaatttaaaatcttgcagtatctttactctgttttgctagttctgtttttccttcttctgttctgatttggtttcattttagagatagcatatactaatggtacaaaacataatcgaatactaaataaaaagtacatctttttctcactatttcttgcattctccattctttgctctaccctcaatgccaattcctgaaagtaaacactactgttttcctgtgtatctctccatcaatattccatgcatagacaaatatttataaatatttaaataagcagacatgtgttcttgtgtgtgagtgtgtatatatatatatatatacacaatgtacatatatttatatatagtgtatatatgtttacgtgtatctgtatgtgtgtgtatatgtgtgtgtgtgtgtgtgtgtgtgtatatatatatatatatatatatatatgtatatgtatatatggacatctttaagtttaccatgcatgggtatacctttttcctatgctataatatgattattacataagttatttttctggcttccagttgatgaaattacattattttttgggtattgtgttactttttgctatagtaaacaatgtgtccttgaacacccttgcactctgaatatttgtttacttgagccatatccatagaataaattcctaggaattatgcctttgctattcatgtctacatgaaacatgctctcagttggatttccaaagcatgaggtaaataaattgcaagtaaattatttgagatattcatatatgatataggtaagcagacaaatgatttttgcctgtatattcatttggccgaattttatgatcacttcctgtcaccaagttaaatgattgtatagcagtctgcatcagttatgaaagatatacaacccttgcattgtttttgcagtctgctcatctcatgcctagagtcacagcttaatttgaaatataatcttttcttttgaaactacagcttaattgaagaacacatttttaaaatggtagaataaggttagaaattattttacagttgtacttgagcattcacatcttgtgcgttattttctcaatataaccaggctatgaacaagcaaatgtgcgtgttatttattccttggtagaaaggctacttagtgccagagcatagcaaaacaggaaggaaaatgctaaaattagccttgtttctcgttcatcgttgatttaattttgggggacatcaaaggtattaaggacaacagactgggaattatcaagataaaaatgacatacccagaaaatactgaattctccagtcctcaaaaagtcttgcaatttatttcatgcaataaatgttaagaaagagggaggagaactggggcaaggacgagggataacatttcttagactcccatctgaaatgaatgattaagggcatatggaatagacagaattaatagcatctgtgatctgtaactaaacttgttgctatagtcagtttgaggattctggtgacacagttaataatcaactattaaacaacagtcaggataccaatctttatttcatataccatgaaaattatggagttcaaatagcctatttttaactttaaaaggcatttctcctttatattttactcatatgctaatatgcattatatgaagatatatgaataagcgaatgaatgtgtgtttatggaacatatgaaatcataactatggcctatgacaatcaaaacacttaacaagatatgtcttcaatttttctatctggatattgggaaaaatagtagggaaaatgttattgtaaaaataaatagataggtttgtgtaggaatgtaagtaaatatgcttatagacacagtcttttagtttactgctatctatatttgacctaaattatatctgggtatttcagttggttgcttgcatttaacacagaatcagtttaaattccaatagcctgaattactaattctgaaaagtatacttctcccatcctccgtttcctccggtgtaaacagaacatagtaaaacctagggggaaagtcttgattaaatgatatataactttatgtttggcctacgtttattaatcaatgaataaatatttgttttgactgggcacggtagctcaagcctgtaatccaagcactttgggaggccgaggtggggggatcatgaggtcaggagatcgagaccatcctggctaacacagtgaaaccccgtctctactaaaacacaaaaaattagccaggcatggtggcaggcgcctgtagtcccagctactagggaggctgaggcaggagaatggcgtgaacccgggaggcggagcttgcagtgagccgagatcgcgccactacactccagactgggggacagagcgagacttcatctcaaaataaataaataaataaataaataaatatttgtttcattcttcccctcttaaactattaccttcaacgtttttcacttttcaccagttaacttctgtccttcattgggagttcagccaaatcgattaaaattatggagtcttctaaaattctttctggaggagatggttaatgggcgcaaaaatatagttaggatgaataagatctagtatttgatagcacaacagggtgattgtgctcaacaaaaatttactgtatattttaaaataatgaaaagagtggaatagaatgttcctaatgcaaagaaataataactggttgaggtgatggataccccaattaccctgatttgattattacagattgtatgcctgtatcaaaacatcacacttaccccataaatatatacctattgtgtacccattttaattaaaaatttaaacacatttaaataaaattatttttaacaaggtggcatatatatgtatataaacaaactcaaaactaaaccaaataaattgtaaaattattgttaaagtcaataaaatgttttaaatgctcaaaacaaattgtgtacatcttcatttatttcatatttctcaattaaaattatatgcaaagcattttaataggtactacaaggtaaagaaaaattaatccatagttcacaattgttttgggtattatattctgataagcctttgtaagttttccttaagacttaggaaaaaaatgaagatacagaacaaattatctttttacttctacaagtaaaacatatctccactggcatttaaagtgagtggtgaaaaaaaatgagaacaggaagttctcatgtaaataataatattgtcaatatttgtgtcaatttctttttttttttttctttttgagatggggtcttgttctgtcactgcagctggagtgcagtggcgcagtctcggctcactgcaacctccgcctccctggctcaagcaatcctccgccttatcctcctgagtagctgggactacaggcatgtaatcatcatgcctggctaattgtttgtattttttgtaaagacggggtttccctatgttgcccaggctgatctggaactcctgggattaagcagtcttcccaccttggcctcccaaagtactgggattgcagatgtgagctaccgtgcccagcctatttgtgtcaatttatatggaaataaatcttaaatataatcagcctttacaaggcagtttggagtatgttgcactcccagttctatagctaaccagaagatgaaaaagctatgctgttctttcattgcctcagtttccttataagagggcatggtaagatgacttgtaagatctgtgttgctgctaaaaaaacatagtctgcatacatccatgccattagtgtttttacttaaagaattgtcatttctgcaataatcaatcacagtgttaggaaattatgaataactaaaaatgtaacctctccttttaccacagaaggaaattaaaacccagagaagccaagtgaaattggccaaaaagcagtttatccattgcagaaccatgtcaaagacccaaatcaagttactaataatcatgtccttttgaattttgtagatttttaaaaaatatataacatctatataacttattattcacctggacctttacttctggatgagtcctttgcaaatcttccttttccgtatttgtatagattgtgtttgtaataggaaattttcaaaaatagcattacatagttttctttacatttattaaaatgggctttcaattaggtactcccaagtacagttacctaggtgatcatgatatgctggtaattgtgagaagtgtgagaattcaagagtacatcatctttcctgataagcaacaatgaaaataagaagatggtagctctaatatactaatgtttagagttattaaagatgagactatttagtaacatcactgatttttaagctaaaaaaattttcatttaattgtctctttccaactgacaaatttggtggtttataatgctgaaaatattttggaatttttttggacttgtcttcagagactatatcgtatctgtttaaatgaccttaatgctaggaaactttgtattcggagtgtgtatgaaatgtagaaacagtcaagtaggatgaatttagttggttaactttgggcataataacatttcggctaaaaatgacatgactacattgtgagggtgggtggtcttaagatagtttataagatccttctaacaacattttaaaagcttagaaacagaagtgtaaatagagacctacatattgaatattttagtacagtctttagcagaaaacgtgtaagataaacagtgaacagtaagctatgtttagttagcatgaagcatatttaggtgagcgacaccctttgacttgcgttctgttagttccacattggataaacgcatagtcaatcaggcacacagatcacatttgctatatatctgttaacattaaattattgtgcaaatataatgatctgttaatactcttaagttagattatgaaggaagaacagtgatttcaaggaaaggaatacaacaggtcctcaagtaatatcatttcattcaatatcgttttattgtaacattgatgagaaaataaataaattgctagccttggttactctctgtgagatgtgaaccctgaaaatttgagacaggtctcagttaatttagaaagtttattttgccaaggtttaggacacacgcccatgatacagcctcaggaggtcctgataacatgtacccaaagtggtcagagcacagtttggttttatacattttagggagacatgagacatcaatcaacatatggaaggtgaacattggttcagtctggaaaggcaggacaacccaaagcagaagtgggaagactcaaagtggggagtgggcttccaggtcataggtagagaagatacattttttgaggcattattttgagtttctgattagcttctccaaacgaagcaatcagatacgcatttatctcagtgagcagaggggtaactttgaatagaatgggaggcaggttggccctaagcagtcgcagcttgacttttccctttagcttagtgatttgggggccccaagatttattttcttttcacagtggagtttgcatgttctccccatgtttgcatgggttttctctagtacttgggtttcctcccacatcctaaagctgtgcacgttggcttaattggtatgtctagatgttcccgctctgcatgtgcatgggtgtgtatgtgtgagtgcaccctgtgatgggatgacatcctgtccagggctggttcctgccttgtgccctgagctgccagaatgggctctggtcatccttgaccctgaactggaataagcaggttataaaatgaatgaataagtgaatacaaattattgtaaaataaaaatttataaagtatatgaagaaagtaaatcatgtaaatgcaggacaataaacaatgctgtacagaagtgcacagggagcctgccatgtttgtgattgtttttgacatgcctagtggtagaaggtgctcctgacaattttcactgtgcaaacattgattccttgatttaacccaccatcatgacaaccagtggcactcattgattcaccaaaacctggataaattacttacttgagaggctgaggtgtcaggattgcttgagcccaggacttcaaggctgcagtgagctatgatcatgcgactgcactccagcctgggtgacagagcaagaccttgtctctaaaaaaaaattttgtaaaaataatcatctcacttgttcttatccatctttcttaaaggtatgtataggtcacacttaattcattgtttaatatgagaagtatttaggtctttatttagaagcttggtcattgttttgtgaccagaaacatgccataggaacttaactcttttctgtatcagttaatctatggtaacgttggtttcatgatactttgttttgcttaattttgcagtttccaagaacctattgatggtattaagtgaggacatattgtatagtcaaatgctccaccatcttcttttggtttttaaaaaaaatggcagtaactagagattttaacaccactgctttgggaaagcaatacattaatacatctcattcaagttttgggtggaagaagaaagaaaaactaagttaactaagttgagctaatgtaaacaaacattgaaattgtaaaggcattttggataactcattgaacctaagaactgtaactacagttagacctcacagggactgtgagcattcttctctactaacacacctctgcttcactgccctcatggctacgccctttctatgtccacttacttcagtcgaccagcttagacactcatggaacatcaaggaattcagtgtagatgattggctcagccgggccaggcttctcccctgattaaatcagctgtggccaggggagcaatgtcagggagtacacagagcacactgagcgcactctgcatgtggtgggaggagggttagagaggcagggtttggaaaagggctgctcatgagctaggcatttgtccaaaaatgtgcctaccacactacattaaaataaaattcaagtaaaacttgaaatgagctagtcaacacaaatcttacgtttggcctatgtaatgtttctaaaataattaaatgttgttccattacattctagtatttctagtccatagctttaaaaatgatatattatgggaaatacttctctagagtatatttcagtgatcatattcttttaagaagaaatttaaattattttttatttataattggcaaaagcttatgacatttgaagcttgttttacttaatcaagtattcagtaattcagccactctgggccttgagctctttgggacagaagcactgcatgtataaatctaacaattacatttgtctcagtcttatctgagcctgtggtcaaggccagacagctgctgacaggttgagtaattctgactgatggaactaatgtccttctgcgtaaaagcagacattttgaaaatgtctcaatctttatcatggtgaatcagcttagagtcatttagcaatctgtaccctcctccttgactcttccacctactgcaccaccgagttacgatgtcacatggatgcacacaagcatctatccaacataaataattagtacttttgtttagaagatggattaatcaatgattcttgctttgtatgaattttcattctttaacaggcagtattgattaccccagcaacaacactttacacaaccccgcttatttgagtccacatccctatattaattatagaaagaaaaaaaaagttggatctagtaatttttaaaaatgaattagaacaaagttacataagcaacaactcaaaacatgcttcataattacagatataagcagatgtacatagagatatggagtgctggcaggaaataaaattcagagacacaaatctctaagtaaccaaacatttttatccttccctggtttagcctaatactaatccctcaaggctaatttggtacagatacaatcttactcagaagcctcagtaaataaaacatctgaaagccttcccacaaacattaggaatgcttatttttcaaatagaaaagtgtttatcttttgtctttcacactgtctgacctcttaataagagatttaagaagaggcagtcacattttccagcattgactatgtatgtgctcagcactttacatgtaacatctcatttaatctttataataaccttgttgtatacatgcaactgaggctctgaaaatgttgtgacttgcccaagattatccacttaaagtataacattaatgagtatgaatgaattatagacatataataatatagacataatatataattcattcatactcacactctttctaccatacaaaattgagaaggaggatttatccaggcaataagtattactgtttgaaatatgtatggcatggcattcaatattgttactgtactaaatgataattaaatatgagcattccttatggaaagaagacactagaagacttagatccaagttaggtgtgggatttggagccaacatagcatttataggcctcagttttcttactcttatttatttaatgtgtcccctcatcccccttcactctacacacttgtcccatttatatgttttatctcagtaggaaataacagatataagatgtgatgtaaatataatataaaagaaatattgcccttaattatttgtgtcccacttatttggaaactaaggttcaagaaagtaaataccaccccatctctttcactgctgtatccccagcacctacactggtctgtgaaatttagtaagcaataaatatttgtcatgtgaatgaacaaaagggagagagtataaattgggaaacatggaccacaaaatgaacaccactatagtactttctctctgtgcgatcattttctgtttatttgtctacaccttccactggacactgagatcaaggttgtcttcaacgttatttccccactagaacagtatctggccctgccatatgataggccctcaataaataaaaattgtcaaaaagcttgaaaatatagggctttttatttcattatcacctggaagttaatgtgggaagtaggtttgcatatcagagtatgtttcttcaaagacacgtttacaaaacagtcatagaagattgtaactgagagtaaatcagagcaaattaaggcaaataaaaaatacagcaaatcaactaaatatttccctgtgtttccagaattttgaggtatcctgaatttcttggataagaatgaaattgttatgaaagaatgaatgtatgaactaacttaaaaaaatcaaaactaattattaagtagatcctggccttttgttggtcggtaacattgcctaagccagtagagtttgtgttctgtgccattaaagaagagcctgttcattttatgttgttttcttccttagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtaagtacacccaggcaacacattgccctagctttcatgtacctaagcagatttcgttgccataagagctgtgattgaataagtaccaggaagatctttgcttttctgccacagtgtctgaagctctgcttactctaattactcttttaaataggaagctgtggcctctcaagtttctttggtagatgcagttttctcaagtgagttggtgtatcaaacagttcatggtaatttgtaccttagcatttagtttattagattggagcaaactaatatttagcaaaatcagggcactatgaaatttttgataaagaatttgtgaaaacagttggagtgtggcacattctctaagcagtgtgtttttggtgagggtgggggatggcagccaccatcacccataagatccctgaatactgaacgactgcctcacagtgaatggagagtgtctgaagaagtgcataggaacaagacaagatcaccttggtcttagatattcttattaaaatacccttttaatcttgaaatcttaacacttttttatgtacatatgcacatatatatgcataatatatatatatatatattatgcatatatatatatatatgtgacttaatcctaaatccggtatgttgtagctttgaggaccactgagcccctcttaatagctccacatgtagggggtggaaaaacactttgcaataataaagctcaaccaattcttggtataaggaagagaaaaagtagaattctaaataagaaaaaatagcctattcacaatcttttgaagacagtattacttaattatctcacaggttattatgaagataaaattagctagtagacatgaaaaatattgaaagttaaagtactatatcagcagtcattttaatagaattattgcttatgatcaattatatacttaataaatacttgttattgatgtatacaaatgtatttcacacataggcaatcacagacacataccccataccacattcagataaaggaggctagctatgtaaaacacacctaaacacacaaacgtacacaaacatgcaaacacaatacacacactaatatactatgtatttttgtaattctgtctttttattgaaattcaaaagactccctaatactgattattttatattataatgtattttatgcatatacaagtctatattcctataatcttctaaaaaggaacgatggcatctttcagaattatattatgattttttacattttactatcccttgcattaatttaaatcgtggactgccaggattaatttcagaaaattctacgtcattctttgtgatatgcaaagtaaccacgaagcaagccgtggtggctagcagatcattcttttcatgagctccctggcaagacaggacttatttaattttagcattacatgtatacccatccagccttgctaaatggacccaatgaatgtaatattaattagaaaaaactatcttgatccttttaaaaggatttttaaagggagaaataaactatgatcaaagaatgtccaaatgagcttactcaaagtatttgccttcttaagcttttggtaaatgttctctatgaccaactaaattataataagtgaaatgtaaaatatagttacttctacctggttttaatcttaaagatttgttagaccagaggccgggcgtggtagctcacgcctgtaatcccagcactttgggaggcggagacaggctgatcacaaggtcaggagatcaagaccattctggtgaaaccccatctctagtaaaaatacaagaattagccaggcgtggtggcgcatgcctgtagtctcagctacccgggaggctgcggcaggagaatcacttgaacccaggaggcggaagttgcagtgagccaagatcacgccactgcactccagcctgggttacagaacaagactctgactcaaaaaaaaaaaaaaaaaaaaattattagatcagcgtgtctaacctttgcattacaggttacttttctccttaattcacaaagaatattcctaagtcattcccatacgaatttattctagcttataaaaattctatatcttacttcaattttaatataaggttataaactgatatattatttatactaaaatattgtatacttatatcatcattttaaagcatgccatttctctagaggtcataatagattgatggttgtatgaactaatggcccatctgttgggcagtggttacttcatagtattttgcttgtcttctaggctcttccctagaagaattttaaaattcttagctcattatggaagagctaagaatttttaaaaatgcctcaaggggaaaatctccaagtgtcttgttcacttctttctggaacgtgttttctcaagttctctttcctgccagccctgaagtctaatttttgtctccttagctctttgagattgccagataattcgctggctttcctgactctcagcatctttcctcatcctggattttcagtctccctttcttctccaagtattaataggcggataccctgaagggaaaagtggtatgctgaatgtagcgctgatttcaataagcttctcttctttacaagattggcctgtcaatgttggctgcctcaacagctttacagtgccttcaaacaaatggttttgtttggttgattttgctttaattttattttgtctgattattctagatggaattataaatcatgtacaagctatttcattatacatagttcagtattttaagatggattttatagatagtgtgcatgtctgcattttaaatagtaataccctggttaagtgttactgattaaatatagacaaagtccaaaattttaccaaatttatataatctagggttaaatttcttatggaaagcagtgaaaatactttaaatactggtgtttcctaagtgctgactttggtctacttttccccctgtacgttgttatctattcttatggcttgacattttctatatgataacccctgaagttgtgtctctagcctataaaacacttttctgagctccatacccatattatatattcaaatgtcttataaatatctttaccagagtgacacacagctatttcttttttttttattatactttaagttttagggtacatgtgcacaacgtgcaggttagttacatatgtatacatgtgccatgttggcgtgctgcacccattaactcgtcatttaaattaggtatatctcctaatgctatccctcccccctccccccaccccacaacaggccccggtgtgtgatgttccccttcctatgtccatgtgttctcattgttcaattcccacctatgagtaagaacatgtggtgtttggttttttgtccttgggatagtttgctgagaatgatggtttccagcttcatccatgtccctacaaaggacatgaactcatcattttttatggctgcatagtattccatggtgtatatgtaccacattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatcgctgggtcaaatggtatttctagttctagatccctgaggaatcatcacactgacttccacaatggttgaactagtttacagtcccaccaacagtgtaaaagtgttcctatttcttcacactatttcatatttagtatgtttaaaattgatatcctaaaatgctttgacccacattctctatgaaatgtccactatccacccacatacacaggttgtgaacccaagttactttctacttctttcaccttacactcaatattctataatcatgaattattttctaatctaactcctaaatgtttgttttcctaatccagtttctcatttcaaccatcatctcttatttcatctcttcagttcagcttctgtcttctttggtatgttgcgttgcctcctaacttgtgcccctatctataatttcttcattttataatctatccattaagttctgaaatatggaaatgattgtattactctgatgcttaaaacccaatggttgccttttgttaccttcaaggttgtagcttgataggtcatccatggtttcacactaaactgctgaaccagttttttaaaaatcattcttcccactctcctcccttgttttcctttgtaactgaattgcttgatgtttcccatgatctcttatttcttttttatttttttgagacggaatttcactcttgttgcccgggctggagtgcaatggcgtgatctcagctcactgcaacctccgcctcccaggttcaagtgattctcctgcctcagcctcctgagtagctgggattacaggcatatgccaccacacctggccaattttttgcatttttagtagggacggggtttctccacattggtcaggctggtctcgaactcctgacctctggtgatccgcccacctcggcctcccaaagcgctgggattacaggcgtgagccactgcgcccagccatgatctcttatttgtatacctttgaatatatcttttatatctcaaatccctttctttcatttgtctacctacaaagtccctgtttttcctcaaagcatcaacttaaatatcaacttagtaaagtatctgttttcagattaaaaccctacctcttatatatagccttggtagactcacaacccttcataaatcctaagattgtactaattatactatattgaaaatatttgtttatgccagccatgtaacttgaaattcagcctggagaacagtgattacttacagactctatggaaagggttggtaagtttatcccttagtggaaatatctaaactagaaaaaggaaggccttaacaatgcaccgttcacaatagggttcatactcctattataatctaatgcctccactgatctgacaggaggcagaccttaagcggtaatgctggctctcccaccgctcacctcctgctgtgcggccctattcctagtaggccatgggcaggtaccagtccacggccctgggtttggagacccctaaaggatatatttatcgcttttgaaattagtgctagaaatgcttccaacttcttttctatcttataattggacggtgcttaaactaaaacaaaggcaaaagtaaatgaaatctgcccctgagtgattgctattggttacccgaagtaactctattgagagtacctggaagtagtctctattgagtagttttatattgaatgtctttggaagtagtcacctagttttcttgggacagattcttggctactttaggtaaagaaaacaagctaaaggagaccttatcatgcaaagtgtagggaggggaaaagagaatataaaaagagtcaagacccagggtggaagtaaagggaatgtggtcctgaggaatgttcatacatagagaatatgccttttatctggaaccccagttatgtgaatattgatagagtgattggagtgagtgtcaaagacatgccatacagaggtgagaggacaatgaagacattactttgatctcaatattctaacttctaagcaaccccaacacattaataaatgtcaataacagtaaaaatgacacaataaagatgataggttgttttgtacttctaaaatgcctgctttgtttcatccttactaattcatatgaattcaagcttaagaaaaatcaacaaataacttattgaataatgactatatacaaaggcttaagtgaattctcttatgcctaagcttagaatttgattgtaatgaaaaaattgcgtaacttcataacttaattttaaaattgattactgttttttagtttttttgttttttgtctttaatttgtagagacaaggtcttgctgtgttggccaggctagtctcaaactcctgagctcatgcaattttcccacctcccaaagtgctaggattacaggcatgagccatcatgtccagcctagttttttagtatttcagttttttagtatttcagcattatgttttactttagatacactaaacaaatctttattataacctactctgattatcctgcttctgaactaaattaccagttttgctaaatcctctgaaaataatctaattttgcaagctatattagaagaaatgttattaatatagaggacaaatctctattctaaattagaactaagtagaagtaattgtactctatgggaaatatgatatcatatgagagtctttattttcattaaattactttaaaagagaatcatgaaaaaaaagtttgttagagagcacatttacttattgtctgaggagtgaacaaagtcaccatacatctttgaaaaggaatgttgtcaggatctcttcatgcatttgctcaggtagggatatattactgcctgtgggtgcacatgcacacgcatacagaaacacaagtacatccacataaaaatagcaaccttagactagcattttctatctattcagaccttaaaattaaaaaatcttgaaagtacgcttccccacgaagtcttcttaggttaatggaatctaagagttagatgtctagcttgctttaataaagtttcccacacatccttaaaacatgattcaaattcttattcaaaggcctgttaactccttcaaatttttattctaaacatgctcagtatatctgactttttatggcgattaattatacaatttgttctgctaataccttgttctcttagtttgatttttacattattatcactccaaaccacaaccttagcttttctgattactgctttgtctctctgagaaaaatccaactaatgttttgagttatatctctcttggcttcccttagttcctggatccgctttgcacagaaggtggaacctaggtgtaaaaagaactttatcaagcttttcatccaatctccgtgtagttcttgagtaaccttcacagcattgctgacaaacattctttcactttatgtttgaactcttccgtgagaaagaacacactttctcccaagacttctttgtgtagaataggaagctatctcttttagattctggtttaatttctaattgctgggttcattgcaagcaagcaaaataatgtgatattttccacatgatactcctttaaatatttctcccagttcttttttccaagctaaacatttctgattggtttatatagtttttcatgcaacatctcttcactattttgatagatctcttctaaacttgttttatgtcaattctttttacttttaagaattttaaacttatagaaaaattgcaaaaattatagagtttacatataccttttatccagtgtgcatacatacttacataattatagcacaatgatcataactaggaaattaacaatgataaaaccctttaaactgcaaaccttgttcaaatttcaccagttttcccccaatgtcttttttctactctgaaatccaatgcactatgtcccattatctttagtgcttgtgtgtccttggtcttcaatctgacaatttctctgtctttccttggttttcacttttttttttttttttttttttttgacggaggcttgctctgtcgcccaggctggagtgcagtggcgtgatcctggttcactgcaacctcctcctcccaggttcaagtgattctcctgcctcagcctcccgagtagcttggactataggtacgcaccaccatgcacagctagtttttgtgttattagtagagacggggtttcaccatattggccaggctggtctcgaactcctgatcttgtgatccacccacctcagcctcccaaagtgctggcattacaggcgtgagccaccatgctgtgccggttttcacttttgaagagtactggtcagttattttatagaataactccaaacttgtctaatgtttttttcaagattagatggaatttacacatttttggctagaatgacacagagtgttaaagtacaagttttttcatatgaacatatgttttcaattctcttgagtatatgtctaggagtagaatttgttgggtcatatgatttaacttgctggtttcaagtatctcgttgtctttggctttcaacagtttatatatctaggtgtgggtctctcggagtggagtctgtgaaacttcttggatgtgtggattaatgtttttaatcagtttggggagttttcagccattgttttatcaaatatcctttctcctcctctcctctgagtcttttattatgcatatattggtacatttgatgctgttccacaaaaatctaaggctatgttaatttttttggttctatttttttttctgttcctcagacatggtaaccacaattgacctgtcttcacatttaccaattttttttttttcttcctggttatacctattgtttggcatcattagtgaaatcttcattttgggtattgtacttttcttttctttttttttttttggagacagagtttcgctcttgtcatccaggctggactggagtgcaatgacatggtcttggctcactacaacctctgcctcccaggtttgagcaattctcctgcctccgcctcccaagtagctgggattacaggcacccaccatgacacccagctaatttttatatttttagtagagatggggtttcaccatgttggccaggctggtctcgaactcctgacctcaggtgatctgcccatctctgcctcccaaagtgctgggattacaggcatgagctgccatgcccggcctagttattgtacttttcaattcaagaatttctatgtggttcttttttatgatttctatctctttattgatattttctatttgatgtcattctcatatgctcatttagttatatagacatagtttcttttatgttttgaacataattaaaatagctaatttaaagtatttgttcagtaaatctaacatctgggttgcctgagggatagtttctattcattattttcttgtgtatacatcatatcttcttggttttttgcatattttgtaaatttttgttgaaaattggacattctatgtggaaattttagaaatcataaatttttctctcaggatttgttgtttctgttcacagtagtagttgctatttattgacttttctgaatttacagatttaatttcgtatatctatattctttgtcacacgtggccactgacatctctgtttcattaatttagtggtcagctaatgattgaacagagatttccttaaatgcctgtaatgaagaaatctcctagtctttgccagaaggctctatgtgcatgttggggcatgacttcaacactctaccaggaagttagtaactgccttaaccttcacattatatataccctcaaagtcaaccagtggtaagagagtctagggccttctcaggtctttcctgaacatgagcaaagcctcaagcatgcacatggcattttaaattcccaggaatgtattggagctttccaaagcttatgtgtatatctcatgctccagcttttcttttaagcttttgaggttttttgctccattgttgttatccactggctcagatagccatgatgttaaatcacttgcttttagttgtttttaacaagtaacttcctgtctccttaccctatacccaaggaatagattttttgcattggctgaactctgagatacgtgaaatacagaaagccttgcaagttgggattttctttgggactgaagctttgaaagagctccagcttcattttgctccccaaacctcctcccctatgggtgccagagtgtacccagaatgagggctatttttccaggctatatgagtctagagagtctccccagccatgccttctgtacagcctgtggaactgtgagttaattaaacctattttcttcataaattacccagccacaggtagttttttataggagtgcgagaatggactaatatagaaaattggtacctggagtggggcattgttatgaagatacctgaaaaggtggaagcaactttgaaatggggtaacaggcagagattggaacagtttggagggctcagaagacatgaagatgagggaaagtttgtaactttctagagacttgttaaattattgtgaccaaagtgctgatagtgatatagacaatgaagtccaggctgaggtggcctcagatggagatgaggaacttactgagaactggagtaaaggtcactcttgctaacctttggcaaagagactggtggcattgtgcccccgctctagggctctctggaactttgaaattgagagagatgatttagggtaccttgcagaagagaaatttttaagcagcagaatgttcaagatgtgacctggctgcttctaaaagcctatgctcatttgcataaagaaatgacctgaaatatttaaaagggaagcaaagcataaaagtttggaaaatttgcagcctggctatgaggtagaaaagaaaaacccattttcagggtagaaattcaagccaactgcagaaaattgcataagtaaagaggagctgagtcttaatagctaagacaatggggaaaatgcctcctaggcatttcagaaaacttcacagcagcctatcccattacaagcccagaggcctgggagggaaaaatggttttgtgggccaggctcagagccccactgctctgtgcaacctcaggacatgataccctgcatcccagcccttccagctccagctgtggcaaaaagggccgcagatatgtctcaggccaccgctccagggggtgcaagccataagaatccttggcaacttccacgtggtattaagcctgtgggtgcacagagtacaagagttgaagcctgggagactccaactagatttcagaggatgtatggaaatgcctggatgtccagacagaagtctactgcaggggtaggaccctcatggagaacctttactagggcagtacagaggggaaatgtggggttggagtcccgacacagagtccctactgggacactgcctagtggagctgtgaggagagggccacagttctgcagaccccagaatggtagatccactgacagtttgcaccatgtgcctggaaaagcagcaggcactcaatgccagcccatgaaagcagctgtggaggctgtaccctgcagagcacagggtcagagctgaccaaggccttgggagcccacgcctagtgtcagtgtggcctggatgtgagacatagaatcaaaagagattattttggagctttaagatttaatgactgccctgctgggttttggatttccatggaacctgtagtccctttgttttggccaatttcttccttttggaatgggagcatttacccaatgcctgtacaaccattgtatcttggaagtaactaacttgttttttattttgcaggcttataggcagaagggacttggcttgactcagataagattttggacttgaacttttgagttaatgctgaaatgagttaatatttgggggctgttgagaagatatgattgtgttttgaaatgtgaggacatgagatttgggaggggacagtggtagtatgatatagtttggttatgtatccccactcaaatctcacgttgaattctgatcccgagtgttggaggtggggcctagcgggaggtgattggattatgggagtggtttctaatggtttagcaccatccccagagtgctgtcttgcgatagagttctcatgagatctggttgtttgcaagtatgtagcttcttcccctttgctctctctttttcctgttctggccattgaagacatgcctccttcctcttcaccttctgccatgattgtaagtttcctgaggcctccccagccatgtttcctttacagcctgcagaactataagtcaattaaacctcttttcttcataaattacctagtctcaggttgttctttatagcagtgtgagaatagactaacacaacttcatatctagaatacccaggtactgaaatacaaagacctaaaattacattttcacaaactcattgtactaaatatatcttaagatatgcctctaaaattatctttgattggagtacagtggaaagagcaggggctttggaggtagatagacaatgagtcaaataccaactcaggcatgttctagttgtgtgacactgagcaaattacttaccctctgtgagcttgaagttttccatctgtgcaatgggcatcataaaacctgtgtcctaggattgtgatgtggattaagcgagatgatgtgtctagggaaaatgcatgtacagtacctggcacagagcaggggacaataagtgagagccatatgtataagtctatgaatgtgtgtctcatatgaagtagtaattacatgtaaacaatcagacaagcccagttaaacattgttgaccctgtaagtcctgaagagttgcttaccattttgctatctccagctattttgaaagtattatttacatcatttccatccttttcttctgcactcatgtttgacataaagattgcaagcactaaattctttaatatttctgaaactcagaagcttctaccaacctgagttaggagcttgttttattttcatcataaatgagaaagaaaaatgtctctaaagcttacagtcttctatgagactgtcttggtcggtgagtgctgctgtactagaataccatagactgggtgacttaaaaagtaagcattatttttttttacacacaatcacaacaaaaatgggatatcatgtgcactttccaatttactttttatttactgaaaagtaaataaaaagtttgctttttatcagtatgtaataccctgtatcggtatgtaatactcattttctgtgtcagtatgtaatacccattacattataatttgtaatgttctattgtgttgatttaatcaacctttttgacagacttctgaactatttctagttcttctttttatcattgttgtgatgaatatccatatataggtatctttgtacacttatgttaatatttttatagggaaaatttcaagcagtggaatgactcaatgatatatgtataattttttactttaaaagatattgtcaaagtgttttcttaaaaagatgcacgtgtttacactaaagcaacaaataatggcagtgcctgtttcccaacattcttgccaactctgggaattataagtttttaatgtttgccagtgtgatttgcacacacctaaatatacacatatatagtaccttaaacttgtatttctttaattattagttatgttttaatagcttcatttatcatgtaccagacactctactaagtgcatactctcattaattcttatacaaccctgtgagtttgaatatctttgcatagatttatacagcatttgtttcttttttggattacttgttcatctccctacattaatttttctgattgcttgctcatgtttttcaatgatttagagagtgtgctttgttcttgctcttttcttgtttccttcttttcttttggaggtgaggtgggctatattatagctattagcttttgtctctcctgaatttttatttctctattaacacatctttctcctatctatttttaaggaaatttacatcttaatatgagatgagtttttgtatgatatcaaattgtttcagataattattttaaatattttgtgtgctaattcaattttccatctacaataatagtacagttaacatgttgagaacatttaaagttatgtttaactttaactcagggttaaaacggtgaaaacatatgttgccataagagtctcagtctatattcatcctaatttattaactagatgcagaatcaggaagattaatgattactttttaatgcaaagtgctaagaatttaggcatttgaaatatcaagcggaatagagcattaggaaataggtaattgtaaaattgcgggtggcagagttgtaatgatagagatattcatgagatcacatttcatcttttttattcccattacaaattttagtgataaaatggaaaattgggcaccttttgttgtcagaagctctataatgcaaagtttttttcagtatttcaaagatttccagttggaaaactgaaaaagctcgtacaaccacagatggtcaagtgtgtattattcaggaaagaaaacagttctttatagaggaagttctgttgtagatgtctctaatgaaaaagggaatacctgcaaatgtaagcatcttgtcaaacaggatacttcatacaatttaagaaaaaccattcctggctcaaaaggattttctgacaattgatttgaggtttgtattatttactttgtagcttctcagaagcaaggatctgcctactctttctttttctgaaaataatgttatatttttcttataaaattaatcaatatttattttagaaattatggaaagcaaaaatatacaataaaaataaaaatcagaggtatcctcatcattcagatataaacacttgatgtgtttctgtttatgtctagatttatacatttttgttttataatagaaaattgagatctctcaattttatctcctgcttatttcactcaatgttatattattagaatttcccatgcattgagtatacctcagcattttttaatggattcacaatgtctgtctcatgatagatttatcaaacatgtttacctttcctcagcattgaatgttaaaattctctccatccccatttttaatatttaaaaatctgcagtgaatgtgctatgttgtatttctacttcacagatcccttgaaatgaaattactagattaaggatataagatttttagaaatattggaattatgaaactgtcttccagaaaggttgaaaatttacaatcgtaacattttttgaaggtaccagtctcccaacgcaagagctagttagtcttaattgttttattagcagtatgattttgatagtaaatattgtatattaggttgatgcaaaagtaattgtggtttttgccattacttttggtgactctccagagaaacagagcttacaggatctgtgtgtgtgtgtgtgtgtgtgtgtgtgtgtgtgtgtgtgtttatagacatttattataaggaatggctcacactgtcatggaggccagctcaagatctgtagggtgagttggcaagctggaaaaccaggagggctgatgtttcaatttgagtacaagggcaggaaaaaaaaatgatgtcccagtttgaaggctattgggcaggaagaattctctgttactcggggaaggatcagccttttttcctcaggccttcaactaattggataaggcccacccacagtagggagagcaatctgcttcactcagtccaccaattttaatgttaatctcatctaaaaccattcttacaaaaaacacccagaataatgtttgaccaaatatctgtcaagttaggttctcctttgtgtttccatttttcttttatttttgagacagggtctcatgttgcccaggctggagtgcagtggtgcagtaatggctcactacagcctcaacttcctggactcaagtgatcctcctgcctcagcttccctagtagctgggactacaggcatgtaccaccacacctggctaatatttttatcttttgtggagaccaggtctcactatgttacccaggctggtcttgtactgctgacctggaggaatcctcccaccatgacctcccaaagtgctgagattataggcatgagacactgcacctggccatttttcattttttaagaagtctgcagtgaaagtattatgtcatatttcaagttgacacatgaaattaaccatcacatgtcataatatgttattgtttttgttgctatttttttaatgagaccagggagtttaggcatactcttatttattcattggccattttgtacttacaaactgtttgtattttttgtccattttcttgttttgttattgatttgtgagaactttgttcctattaaagctattactttgtagtattcgatgaaaatatttgccacgctttgtgatttatgtttttaaattgcagtaaaatctatccaactttttgtatatttttattgcatgtttcagaacatttttcttcaattacatctttcaataccattttattccatttcattttggagggttctttttttcctgaatatcaattaacttatttggtctttctatctcacacatttgcattatattttctctaattcttttctctttgtgtctttttctctcagttgttgctaattcaattgcaagctgtgtttatttcctatgacactaaatattgtaacattatttttgcttgatattattcacatcagaactcagaaaatatgatattgttttttctagcattttgtgttaaagagattagcctgatatttttccatttagttaaattttttcttcaccttcatgaatgcttatagatcttaatatttttatttctataatgtaaaactttgagctgagtatatataattgtagctattttttcttaaacttgtctggtcttgggtgggctcctaagtccacagacgcggtgtgttctgctcaatgaaatttttcaatcttacacagtctatttgctattttttcattgttctggaatcagagacgtcaaagtattgtgagtactttgtctttcatgttcataataatcgtgttttttaaaaacagtttgcagctctttgactttatcccatgcatctgtcacagcttctccagcttgtctgctatgaaagtgattttggattctgcagtgtcattttgcttattactgcttccaatgcgaatgtcaggtgttatttcattttcccccatttcttttcctcttttgttaaatccctcagacaacctttatttgggccttattttgcttcttttcctttgggtttgtcttcttggatcctatttagacttccaagccattttctaaattttttctggcccctttaataattttcaaaattattatcttttttttctgaatttgagggctttcactttttcttctcatgtacccatgttgatattttttgttaaatttatttactcattctagaatgagatccccatggggcctcatgttgtccaatacatgaagttatgactttggttctgttcactttcttcttagaatctccattttcaaatatagagcctaattttaaatgtatgtacattataatagcccaattaacagtgattagtaagtattcatttactacagatctgtaagatggatgtggtagttacctactgttacctacatagcctagttatctgatactttaaaaaccaatgaaatatatggaaaatgtcagccccccagtagactctactcctgaggtttttcttgtctctgtacctgtgtaatagatctttccttacctcccagggtaccacactctaacacagtccctttacttcagctactcatgtggaattggtgagctgcagcctctaaacagtatataaaggtaattaggactggttgaagggatggactgctagcataagaaaaggtggtactcagtcccaaaaagaaattatttgagctgcccagctttttagtggatagaaatcctgcgccttttaattgagtgaataccaggtaaaccattaggtaacttgtttcttcttgggaaattaaggtgtaatgaggtacagggacagaataattataggtagcacagctagaattaaaccacatgtatctgacttatccacagatccatagctgctctgaaacatacgctagaaatcctattctgcttaaaacacagtcactggtgatattttatatgactatctgacagtttctctgaaggtagaggaagcagtgaggcaaactacttgacataattctgttcagttctagaaatagaaatgacgagatcccaggagaaaacatctcgccttgtggagcccttgataaacagggagggaaatcctgaacgtaattaaatgtgtgtacacactaaaatttaggaagatccatttttaaacactcagacaaaaattggatatttcatgaacagaggtactgaaaggaaagagtgccagaggaataaaagtttcaaaagttaagttcaaatggaatggttgggaataattttaaagaaaaatatttacagtcatcaaaatcagtatgggtacatgtattcttcccggtggactcagatgtaagaaggacatgtataatgaaagaaagtaggaaagtatcattaatgggaaaagaatagccaatgtaagaaaaagggaagcttaaatctaaaatgaagtgaggcttgctaaaaaatgatgaaatggtaactgtaggaaaagagaggccatttaaagtatacattcagattaaacatgcactcaacactggagaaaatgtcgactataaggagatgttacagtattagaaaaaggaaagaagcttaagtcctattttgcttcaatcttctctgtcaaatagaatatttggggatgggggaaggctacctgtaaaagacttccaactatcagataagtgaactgatgaaaaagcatctaggtgttctaagtaacattgtgttttcttcctgcatgaatgataatattcaaatatgagagaacctgatgaactgactttgaggaatgtagcatgcaggacagtttcgtaatggaaaacaaatgaaaagcaaatatttttataaatctaatttataaatctcaaccatcttatgaatcctcaaaatctaatttatcggctttataaattagattctgaatcctcccggtcctaaaaaaaaaaaaatttcgtaaaatatcttattcatctgatttttggggaacgcttagggaaagaaagtggtgataaactagaagattatgtatactattagaccaacttcctttgcaaggtgtataccaacataggagaatgctatagacattgtaatctttcactttgactcctgactttcttaaggatgaaatggtgaaatatagactggatatagttgagttgttttgtgattgctttaataaatgtacctaagtattgatttaatcatttgttgtgaattctaaagctaaagagaaatgctggaaaacactggggcttcagggggagaatggccatgatggttaggaggatgtcatatgccatcatggagagggtcacagatagaagcgagggggagggctcaagtgtgagaagtcctaggggagagagcatggctttcttcaaatgaataactgacatagccaaaaaggaggcctggagaatcgactgggagaggcaagcattgaatggaagttaactgaatgaactctgaagttcttccctcaatgttttataattttgttctcttttataaacctaaagtacagacatattttttaaattgttgttaaatgcaccacattcaaccctacactaaatttaagtggatattttgtatattttctcagaattcatcttaaactttatagcttctttatgctggtttcagagtaaatgctcaaaaaactatttggttggctgatttaagtttcttgttgctaaaatatcacctaagatatggcttgtaaaccaaaattaccttctcttaacagaaaaagacaacgtaagatacttatgtaaagaaatttaacagaattttaaaattatatcttaaaattgtatcataactttgtaaggcaacaaatccaatttgtttgctattgctgtgtatatatatatatatttttttgaagtgcagtggcgcaatcttggctcactgcaacctcgcctcctggattcaagcaattcttctgcctctgcctcccgagtagctgggactacaggcacacgccaccatgcccggctaatttcttttttgtattttagtagagacaggatttcactgtgttgcccaggctggtctattgctatttatgttgtgaaaaatctgcttatgctgcactctcctactttattatccacagtcttgttcctctaggtgctcaagctagatcatttggagtcatctttggcagcactctctcaccaatttctgtatcctgttagtcacagggttattgatcctttcgataacacttaaaacctgttctctcctgtccattcttatttcacaggcctaattcaaatcctcatgatcttgagcaaagtctattgcaatagcctcaaaaccagttatatcatttacccccattccaatgctttgcctctaccatcgctatagttcattccaaaacacagatctgcttaaaacccttcaggaatttttaaatccctggggaaaaaaaatccagactcttctacacagtatgcaatgtccttaattcattggccccaaccttcattttcccagcctttcatagccactcatgcctgctaagccctgagtctgtatttttcaaactagaatacttgtagagtggccagagtcacagagccacaggatagacatcgcccatgttcctggaagtttaattttatttaaatatctaggattttttaaagtagctcagctggtaaataagttaaaatgccatttttatactacacaagttataccctgtgacgtctgaaggggaatacaggtacagagccttacaggggcagatgcaggtttcaaggagactgacatgtctgtgatttggaaagccaaccataagaaatatgtacaaaattgcaaatccaaaattagatacaaaaatgaatatttgtaaagagaaaaaagtcacaacatattgtgtacttaaaattttgacaaacaccacaaacatacaaaatccagaaataaagtaactttattattagttgtcagacatacctctctaatttttttcacaaaatttttgtatactttttgatcacctctctgcatggtatcaattagtaagatgttctatggagaaacctgaatgatagataagtacttcctctaacacggtcaattgaaatctgttcctatactcatagatgttctcactgttcatagtattgctacagattattcacaacaaagacagaatcctcataaattctacttcatgtgattttttaaattaaaaataagtatattaagcatttataatttaatatactagatatctttctgataaaaagagaaatacgggtatgataattggaagcatttttcatagatcagcttctgtatctgttcttctgtatctggacccagttggacattttcatatctttgtataacctctgaccctgcatgtccctgtcactgttgccacaggaggtggtacagtgggtgattgccaacaatgacttcatgataagtggaagtgcctgcaagccacatgaatatttcccacacactccagcaaaattaaatctcatctgaacttccccttaaccacatcccaaattaccagtcattccaatatacccaatgcaagagcggttatgccagaaggaaagttgggattgaaaagacagtggccttaactaatcgtaattaaaatatcttagttttacaaacttaacaaaaaatcttcaccagttgaacatattgctggggccactcctgaccctggaaggggccatgcaagtgagtggccctgacacttaaacttcattagcttcatggtacatctacctctggttcattacaagaaagaccacactttactggctcctgataattaatacaaaatgttttttaacatatactcatagtgtagccttcagtgcttagactcattccattcttttcctcctttgatctccctacctacttccttttctctcccctgggtcctactccatcctgctactgcctcttgtggtcacggtcaaagatgcccatttctgtctccattttgaaaggttactggtgaatccttatatcctcagaacagagcatatataagaaatacaaatgtttttcttgataatattgatttttctctcatagctttaagtattagtattttgatgtactgaaagacttccccctaccttgcagagaggttgagatggaaaagagaacagagccgtatcgcaagtgaaaatacataagaaagataatgggaaattccagtgcatttttaggatgaaacagaagaaatcaaagaaactccatcttagcagtgggccttttaaagctgcaacttcagatcaccagaattacccattcgttctttgccacttttctaagtggaaaaatctgagaaacactgctgtgtacatattcaattatactactaatagtattatttcctattttgccctttgcttttttttagaagagcatttcccatctctgccaaatgattttttactcaactttcaaggtctagttcaaaggttattattctatgttattctatgacacgtcctcaggacacttaaagcaaaattaattgtgtctctttcttcttttctaatggctttaacccctattttatcatttagaagatatcttacagtcaaatatttatctctcataaataaatattaggtcataatatttataaaggcgatgtctcattcttttttgtaatccaggaacctatcctgacagtgttgtgctggtaaatgtttaacagctgacttccgtggtcaggagacaactgacttggagcatcagttaatttctgtgttttaaattctcccaacgtggtagcttccaaactaccaatggagaatcactgaccacagaattggaaagagatgcatacggcacactattctggggcatttctaccagatagatatagtagatgcatgaataataataaaatgtagcaaaataattaagaagtcatgagttttcagtatttattacctttgcttttaatctacttaattgtaagtctatataattttatttatttttttatttatttgagacagagtctcgctctgtcacccaggctggagtgcagtggcatgatatcaactcactgcaacctccacctcccaggttcaagtgattcttgtgcctcagcctcccaagtagctgaggttacaggcaggtgccaccatgcccggctaatttttgtgtttttagtagagagggggtctaaccatgttgaggcgggtcacaaactcctgacctcaagatatccttccgtctcggtcactgaaagtgctgggattacaagtgttagccaccatgtctggcctgtataattttacataatggttgtgtttaataactggttcaccaaattcttgaaaatttaaccatcagttctcatagagctagtacaaaccagccccagcacagtattttacatggctccttgaaagtgaatattgacaaatcacaacagacattttcagaggattctagaaaaaattcatatttgtagtggaggaggaacactaattctgacccttaaattgatactgatgttatcctcagataatctgttgcatttatatgcagcttgctatctcttcaattcataaaaattctcaaaatgtgttgttcatagaagtaaatcacagagtaacacaaaaactgttgatcattccctgagttctttcaagcttgacattttcctttgtatagatatgaggtcaaagggagcaactatgactttccactcacagaatctgggcaaaatgatctttcatcaaggcagatgataaagagaatagatgtgacatcaagaattgttgggatttcctcggataaaaactcttatagactcattattgcaattctgccacaggtctcagattgtacttactggtcctgttggagacaattgaaacaagacaaggcaaataatacagctctagtgtgttccaagaataacagaatgacttactgttatccgtcccatgagatgaaattagatatttctgagagatttcagaataaattttattttttattctaaatgttcatacctgtaatctttgctctatcatatagtaaatatctgtctataacagacatttagaaccagataatgaaaaataattggaaattttcttttctaaaagctataacttttgaatatgattttaataaaagaattccatgtaagttttttttctattttgcagtagctaaagagaaattaattagtcatgtcatgaaccaaagttatataatatgtgtttataaaatagtactaattcaccacactaaattgactggatttcaaaacattctatcacagcccttcaggtatttagagtcaaggagaaagagagactaaaagcatcggaaaattaaggacatacaattaaatatgtttcaataaattaaggatagttgtataaattataagtacaaatttcatgtgtttcttaaaacatcacaagttgctttaatttttgagttccattaaggcattacagagcaaaaaaaaaaatgttgacttgatcagggttactctggtaattactcttatcatcttagcatttcattcgtaagaattggcctatggtagattacaaacataatagtctttaaacatgaattactaaaaactggccgggttaggaagtctgtgttaataggggaacaaaatgaatggggatgcataaaagctaactacaacatgacacacaggcttccttagaaataaataatgagctaattcaccatttctgagaagcagtagtttcatacgcagttcctggggtggatcaaaagaatcacctaaatatgagcacacatctatccatcttctaaaagaaaaggaaatgctcaactatacacaaaggctatgttaaaacaccaggcttgttctcagaaatcagatgatcttggagggacttttcattgacttttgtttggcctgtgcaggcatatttatgaattgtaagagaagctgaaatatttgaaatagagatatcaagttctcatttatttagatgaatttttagtggaccaaaaatgaaatgaaaggttttaggccaaagatattttcatatattaaacccaccaggaaatgagtactttaaatgacagtcaccccataatacaaagaaattttgtctgatttatctgaaatgctaaatcatgtactacttacagtggaaaccttctgtaaattttctataagttaatcaaatttgcatcctaagaatcacttttcattcatttaaactgtattgatcttaatctctgaaaatattctgaaatttttgaaatttatttaataattattagacaaagtaatattttcttagtgctgtgtgctgtattgtaataattgatttacctttctttcccactaaactataagttccctgaaaatagaatttcaatatcatttgactttggattttcagcatagtgcacttaaactcactatttgatgagtgaatgatttcttagagaaagatattgaattcaatttatgttacaattgttaatatgcataaaaaatatggaacaatatacgtcaatctactagcagtagttttctctaggaaatgggatggggaaggggtatcaggagtattttactttctgctttagatttgtatgattgtcttcatcacaaccttgctttactactttcataataaaaatgttgaggacataaaaaagtagcaccttaaagttagtagatgaaaaacttggcaactatccaacttcttgttaatgtttatggtaaagtcttcactaaattgtattaccagttattttattttctgaggaagaaaaattggatttgaatacttttatagtcaagaacatattatttctagttcttttctgatgttttggatttgtcttctcttcacagttgtgtgtctgtttctctttcttccagagttatcagtttccttatttagtcatcttcaccctaataagtggcaaacaagcactactgcctagattctagggaatttcactccacattttacctcatctatttagaacattatgatgttcagaatacttttgtagacactctatatgtattaacatattaatacattgtgtatatatccaacatctctaatctataaaactagaaaatggtgaatttaaatttctgtgttctttctctaactagtatcatcattatcaagttatatgtttacgacattgccggtattttccattcacaaaggcttttcccatttagatttgataaggccaggggggaaaaaaaaaagcaatgctaacagaaatggtttcgtggttaataaagctactttattagcttggaattgcatttcatggatagtagtagcaattaaccaatttatccatttacaccaaaacacttctccctgggaaatgagctacaatctccttcaatactgaaaattcccccaggtatctgagcacttcattccccacccctctcttcacggccaataaaattaccctttctttttgattaaccattatagtgtatctcacatttaacctttccttttcattcccactattactgcttaaatccaggacctgaaatacaaacgacttcaatagcttgctaaccgtgttcagtttttctttacactggggctaagttgttctaccttcctctattgccaattcacctggtagctggtttcctacttacttctaaacaaaatttgatttcccttaaaccagtgttcaaggtccctggatacctttcagcttggtctacaactgttagacattccgtttattccagtctggttggaatacttgttattattccccattgaacaacttacgctttcctttctccgcccattttcttataccatttatattaataagttgccttcagttctcctttataatctattaaaatcatattctttagacctttaaattatttagggttccatgaccttctagaagccttgctttatttccattatagctgggttctttcccctatgaatagctatttatttgaaccatcttatgacacttaccacatattttcttgtatcatcatttatgtagctctcctcccattactttctttatttcctatgtgtcaagtaatgtgctcaatgctgagggaaaagtggaaaacaaaaagcagttttctccctcttgagacagggtccatggtaatgtatattcataaatgtttaaaatacataattatatatatgtttttaattcctttttaaacttttattttaggttcaggggtacatgtgaaggtttgttatacaagtaaatttgtgtcatgaggggttgttttacatattatttcaagtattaagcctattacttgatagttatttttttctgttcctctccctcctcccacctccaccttcaagtagacaccaatgtctgttgttcccttctttgtgctcatgagttctcatcatttagctccaatttataggtgagaatatgcagtatttggttttctcttcttgcgttagtttgctaaggatgatagcttccagctccatccttgttcccacaagaaaaacacatgatcttgttcttttttatggctatatagtattccatggtgtatatgtatcacattttctttatccaatctgtcattgatggcatttaggttgattccatgtctttgccattgtgaacagtgctgcaatgaacattcacatgcatgtgtctttatgatagaatgatttctattcctatggatatcatacccagttgaatgatagatctgcttttagctctttgaggaatcaccatactgctttccacaatggttggactaatttacattagcaccaacagtgtataattgtccccttttcttggcaaccctgacagcatctgttattttttgcctttttaataatacctgttctgactggtgtaagatggtatctcattgtggttttgatttgcatttctctaatgatcagtgatactgagctttcttcatatgcctgttggccacatgtatgtcttcttttgaaaagtgtatgttcatgtcctttgcccattttttagtggggttgtttgctttcctcttgtaaatttaagttcctcatagatactgagtattagacctttgtcagatgcataatttgaatttttttctcccattctataggttgtctgttttctctgttgatagtttcttttgctgtgcagaagctcttaagtttcattagatcacatttgtcaatttttgcttttgttgagattgctgttgttgtctttgtcatgtaatctttgctatttctatgtgtagggtggtattgcctaggtggttttccagggattttatagttttgggttttacattaagtttttaattcatcttgaattgatttttgtgtatggtgtaaggaagcagtccagcttcaatcttctgcgtatggctagacatttatcccagcaccatttattgaatagggagtcttttcccaatggtatgttttggtcagcttagttaaagatcagatgatcctaggtatgtggccttatttctgggctctctattttgttccgttggtctatgtgtctgtttttataccagtaccatgctgttttgcttactgtagcctcataggcaatcccattcacaattgccacacacacacacacacacacacacacacacacacacacccctagacatacagctaaccagggaggtgaaagaactcccggggctgaagcctacttgatcatggtggattggctttttgatgtgctgttgaatatggtttgtaagtattttattgaggatttttgcatcgatgtttatcaaggatactgtgctgaagtttttcttttgttgtttctctgccaggttttggtatcaggatgatgctggcctcatagcatgagttggagaggagtccttcctcctcaatttttttgaatagtttcaatagaaatagtaccagctcttctttgtacatctggtagaatttggctgtaaatccatcaggtcctgggagtttttttgttttttgtttttttttggttggtaggctatttattactgactcaattttggagcttgttattggtctgttcagggaatttatttcatcctgattcagtcttgggaaagtatatgtgtccaggaatttatccatctcttctaggttttccagtttgtatgcaaaggtgtgtttgtagtagtttctgatggtaatttttatttctgtgaggggcagtggtaacatcccctttgtcatttctaattgtgtttatttggatcttttttcttctttattaatctaactagcggcctatatatcttattaattttttcaaaaaaccaactccatctttcgaatggtttttttgtgtcttgatatctttcagttcagctgggattttggttgtttcttgtcttctgctagctttggggttcctttgttcttgcttctctaatatttgagtcgtgatgtttgactattaatttgagatctatctaactttttgatgtgggcatttagtgctatgaatttccctcttaacactaccttacctgtgtctcagagtttctggcattttgtatctttgttctcgttagttttgaagaacttcttgatttctctgttaatttcatttttttacccaaaaatcatttaggagcatattgtttaatctgcatgtaattgcatggttttgagcaattgtcttagtcttgacttctgtttttactgcactgtggtttgagagtgtgtttggtatgattgtggttcttttgcatttactgatgattgttttatgtccaattatgtggtagattttaaagtatgtgccatgtggcgatgagaagaatgtatattttgttgtttttgggtggagagttctgtagaggtctagcaaatccatttggtccaactttgagttcaggtcccgaatatctttgttaattttctgcctcaatggtctatctaatactgtcagtggaatgttgaagtctcccattattgttgtgcgggagtctatgtctctttgtaggtttctaagaacttgtcttatgaacctaggtgctcctgtgttgggtgcatatatatttaggatagttaggtcctttaggtgaattaaaccctttaccaatatttaatgcccttatttgtgttttttagtctttgtttgtttaaagtctgttttgtctgaaattagaatcgcaacttctgcttttttctgttttccatttgcttggtagattttcttccatctctctattttgagccaatgggtgtcattatgtgtgagatgacagcgtacaattggggcttgcttttttatctggtttgccactgtgccttttaaatggggcatttagcttgtttacattcaaggttattattgatatgtttggatttggtcctgtcattgtggtgttagctggttattatgctggcttgttcgtgaagttgctttatagtgtcactgatctgtgtatttaagtgtgttttgtattagctggtaacagtctttctctatttagtgctcctttcaagatctcttgtaaggcaggtctgatggtaatgaactccctcaacatttgcttatttgaaaaagatcttatttctcctttatgtaggaagcttaatttggctggatgtgaaattttagttgaagatttttatattttttaaattattaatcagcctttaattggctaatttggaccatgccatgccttaacaatgacaaacaatatcttgtgttttttaaggatttattcattatctggtttcaggtattgtgtggtaggaagttctttagaaattaccagaccctggagggtccttgttcttacacactctagcccccatcctagttctcagtccctgcaagcttcacacacatgtgaacaaatgcagagaaaaattacttgtgacccaggtcatttacctggtctctttttctgtcttaatttccttaagctgattattgattacaaagaaaacctctggactttggaggtaggggaaatgctggccaatatttcatgaaaaccattcactgtcctctgcatcattagtagaagaaacagacatgcaatcctataagcctaccaaaggtcagattgatgaattttaggtatcctgtggcaaatggtgaaaatcagagatgacgctcacctgctccagcttgaggatatagactaagttaaaatggaataaaagataatgtgaccaaagaaaagaaagtcatttagttcatttttttgttgttcatcaattcaataaatattttttaagcaccttctatgtgccaattgctctagtagacactagagatacagtaataaaagtagtccctgatattaatccttggtgttagtaaaaagagaaagtacagggatgaaaagggaagctaatgagggaacagagaaacagagaagagaactttaacattgatctagactgtaatatgattggaagacgtagggatattcaggatataaactgaagagttccaatgggagaaccgtttatgaaatcattgttccattgcactcagtagtaccaagcagtccacaagaattgacacacatttcaaacatgacttactacaagcatggctttcaaaatggatatatgtgactcatgaagagccttgttcaatctactattgctaaactttcaattttgacatatttttcattaagaggtgctgttctgtcttgcaatactgattgaccagccgccaaaccacatgaactacatttggaccacaattggcagaatgtattctaatgtgaaagataatacagcaagtacttctttgtaattccatgttcaaaatgaaagtataaaataagcaccaaaaaaaaaatgataaattttccatttaaaatgtaccagtggatctgtgggggtctatgaaatgtcttttgctttcctatctgaaggagagctcaagttgtttatattgtgctgttacttcagcagtgagtcaggaacactttatcctcccgtggcatgaatacagggggtgattgcaggcaaaacaaccagtcagagcaattattacatgctctttggaactctgtgctgtgcctcttggtaaataggattttatgataaaagcatcaagatgtagacatgtcaccagtgatgtgaattgttgttaagtagagttataaggtacaaatgtatgtatgcccttggatgtgaatttacccccaggacaatgttttccagtgtgtggtttccaggtgacttgtatcactagaaaatttcgatttctagtctcctacagagattcttatttctcaggtctagtgtgggccctgggtgtcagcactttgaacaagtcctcagaggattctaatgcagattgaggtttgaaagctatggacctagaagaaaaagaatcacttccaatcagtcaacataactaaattgttaacagaaaactataattttatatattcagcagtataaagtatatatgatattctgaaagaatgtaaaacaaatatattatattgagagtattcataatctaccctactatgtttttaacaagtacatgctggatcttctatattcacttagaaaaagaaaatgatatacagagacctaataaagaacctggttctgaaagggaaggaaataccttttctgaaagtctctgagcatcttttctctcttctgaccttgtctgttctgaaagatgaatgtcctacaggcaatcccagggggtcttcctagactgcaattctccctgcccttaaatatgtggagttaactgaagctccagacagctcagctccagatgaatttctcaaacagttccttctgctgtcccgggacctggccagagattccatgggagatgcctttggtaaactggatatgggagatttacatagcagcatagtgggagagaggttttggcagagcctcttcaagagaagtgttgaaagaaaagctgagatttatgttacacagtatcttgacctcaagtagtgtttgctttgggttcttaggtgtgaaaggcaacttttgcatttctaaaaagaagaaacttgtaggtcttgcataccatgtttgccctaagtcagctaaaggggaaaatgcaactggacattcatacaaataaattaagaaattaatcttaaatccttttgttaaatagtcacatttggattcctttatgaagctgtcttctaaagcagagttatactgattcaataaataaatatccctatatttgatgaagcaaacttaggattcatgctaatacaaatgacagaaatccagtgtaaactgccatggcttaagccttaaagcttaagtaagttggcgaatgactggcttcaatcattgctgaattcagaggttcaagatgtcacagcattctgactttcaccatctaggtgttgagccggtgttatagaaatcggtcatttcatcactgtaagatgcctccctcagggtggcaacataatggctggtggcttcaggttctcatcctttcagcctaccagtccagaagaaagatagtttctcttttcaacagttccaacagaagttctaaataggagtcctgttggctgcatggattcaatatccacgcctgaacttatcattgtggctaggagagcagataacattgattatccaggtcatatgcccatggctagagcaaaagcagggaagatgaggtcagttatgatgaaatcacatgaatttcaaaggaaattctaaactgctgttaccagaagaacagggaataaatgtactggcaactagcatctatgtctgttacacaggtacaccataattagtaagtagtaaggaaagtagcagtgggctttttgtgcattcacctttgtgattgttgtctcctttaatctggtatggatgatcattttagccagaacacctttaaccactttttcttaccttaagacttatactatttgatgagtctgttatactttagagcaaagtgagaccaacattaagacagctcttcttgcccttggctaacagcaacagatgtaatagctttgaacattgctgtacattaatttacttggttatttctcttctgtgggaaaaaaatggatatgatgccacttgatccctcttttttcataaaagtctgatgacttggaaactgttttgtaattattttttaatccttaaattcctgggatttcggtgatagatgtcattcaaacaaactggttgttagtgaaaatactgctatctgagcacatgacccttaaaaaatgattattttctatttctccacatcgttagctcttcagattcactatgattatttaaatatatgtagagcgaaatctaattattctggtgcagaacatttttcatacatttgtttaactatttcctactctctgtctgtcttccacccccaggtctcatgctttctccctgtataattgtttgagcagctagaatgttaaaattttcacccaataattgggcctgtcaaagccttagtgattaaagtatgtcatgtttaagaaagttttagaagaaatatagtgtttctaactttaatttttaaggcttatagttacggcatattggctatgatttcttccccatggatggcaagtgatgctcctatccgtataaagttaactggtttacattatttctgagtaagtcccagcaattgttcttgtcaggctaccactggtgtatgcttttgtaagctggccttgatcccaaagagtagggctaggaatctaacatgtgtccggttccatttctcaaccctctaaactatgtaactttcttagtgctgacacactcactggcctatattatttaatcagctgatcacagaaaaaagaatttgccagatagcttccattacatatgacttttcattttagaaagtactttcacgtatattatctcacttgaatctcataacagatgaggtcctattatcttaaatttgcaggtcaagagtagaacttagggaccttaatgacttgcaccaggttacatcactaggaaatgacagagtcaggtctttgactctggactgtctgtgttctttcaatcacgccattgcctggaatccattccagcatttgcagactatgagacagagctaagcatgtgtgaaagacccactgccattgttcacatccatcaagatggctttaaggctgaagaatgtgcaggcatctcagttggaaggcatgcgagcttgatagaaattgagacactaggaagacactggaagaggaatgaaccagcagaagacattttaaaggatattaagcctactgaacaccactgcttcgacatctaaatctttgaaatattatttaaggggtactgactttgagtacaagttagttcttgtgctacctgtacacaattcaaataaaagaagtattttcgttgaatgtcatttcatttgaaatatgtttaagtttgagtactttcaagcttattcattcccagtttgctaatatgtaaatgagagtttactttttctcttaaggcctttttatatgttttcaaatttcagtaggaatttaaagcaaatctttccatatcagaaacagacacaaatcaatgctttggatcctaagagcagttatttaaagtcagttaacttattgttggaactttgaattgctaaaggaaaatattttatctaacctcatttttgtattatttctagaatgtcaataacaactgtcacaaatgatatttttgaagagctataatgtaaaatggcattaggttgtcagtttcacttaccagcaagtaagatatgacttgaattctatacggggcctagcctactgtctttcccttggtggtattatttttctcccaatttcctcacgatgttgtatttacaaagttaagtacagaaaatccaatttgagaggctggaagcagatcaaatggtttaatgagctcagttttatttatattaggtggggaaatcaaagctgagactaataatttctgtgcccataaaagaataagagacctaattaagcccacacagtgaaccaggttagagactgcttatcttccacatttcctgtgtgaaatagtcctgtcccatctcatcagctttcatgtgaatctttaccaaggaagtgcaaatagaggtatctggctgtcctgaaaggatagcagcaggtagatacagtgtgattgcacccctaaattattgtttctggtgtggcacagacaaacagtgatccttgtcctggcttttgaggaaatacctaggaagatatgaattttatttcaaaagaagagtagtgcctagataggaggtatcataatgtctgcatctagaacagctgtaacatttggaattcagatctagctgcttcctgtgagcaaagatatacatccgagaaacagccaatgactgtcagcttgtaactgattgcctacctgtaagcatgggtcagcaccatattagcgtagtcttcagtcaagaaaagcggcaatcgagagtatcaatatagtgacacagattctaaaatcatacaaacaaatgatagcgcatgcaacttgaaaactttttgaaattgaaaaaacacagtggaatacctgatatagttactaatcacagtcctccaaacaatttcattttgaactagttaaaatagcataatcattatcttttttctagctttatctgccggattcgattgtagcagattctatccagtgtatttatcaatgtaatctagaatctatgatgacagatcttcatgagtagaatttataactgagtaaacctagtatttgtgctaaatccggacttaggcttaggtccatccaactactcatcgtgtcagtggagcccaaatggtgagaccactaaatttatcatcagggagagtttagtatgaactccaaaaattctctatggctttttgctgccataaaaataggcaggaaaaaatatttcagtaaaacatttgattcagaggctcagtaggttacctactccctgtgctttaaggtttatggaaagaaaagcatctaggcaattttctaagttctagatacatttgtagtcttatttatgtaactcctgtaatcaaggctaaatgcagacagctgagagttcggtttggcctgtatttacttgaaatggctaacacccatttacaggctcataaatctttcaagtgttaccactgcgtgcatttgtggaaccccacccccattcatgaacaactaaaattgggtcacagataagcttgattacttgtggggaaacaatttggggagatgaatatgtaatttagtttcccttaatgtgagggatgaatttgttccaacaggtttacaagttacagttttagcctgcagctttctgtgttgctattttaaaatgtcatatttaaaggagacacaagagctaaaaataagtaaatttaggtgtgaagtcctagggccttggggtaggacatttgggatcctatggatctttcgataactatgaagcccacagttgtctcaggacttacttatttttgtgtgtgggttaaaacagaaatgattgatttttccccattgaagataccacagataaaaactaattatcttaatggaaacttgatgcttaaacagaaacctttctttataaacaagtgtatattgaatttttacagttaataaagctagtgcttatatattaaaaacactcttgtgattcaaaacaccataatgtgtagctaaacaatgagttttatacaagtgctatgtacttggagtaagaagattaatctgcagctattcacaaggtgagttaggggtaagataccagagcccaggtgaaaagcaaggaggtccttgttacagtataaggaagtgaggaaggtgaggtgataaagtgggaatggaaaggaaagcaaatacctgatactggagataaagttgttgctgtatattcaaatgaaaaggtatatatgtgctctctttttcttttgtttggtttttgagttagggtttcttttcctgaattgtttagttgccagaatactgggtgaaagagatttggaaattctctctagtatcaggtttggaaatacaccatatccccatccatggtttctatttcagaatggcaaaaagatcctgggccacccaagctccagggctggcttgatgggcagggaactcagggtcctagcagtgctttctcctgaagccatgagcaaggctgttggagttacatttcttttttcgaaaattcgagtggctatactgacaagagatagatgaaaaacagggagtatcactaaaacgcttctaaaatattatttttgtttatttttaggacctaaatgtaataactaatatatagtaacttgtcacctacgtgtaactgaacctcagttctctcaagttcatcttttcgtgtttttcatcttaaataaccactatgtctcaaacttgagtacacagtggaatcacttggaaaactttttaaaagtagtactaattcataggcccaatcctaaaccaatttctgcacctagggcctcggggccaagcatgagtaggttctgaaatctccccagctgattctaatgtgcggcaggattgagttcctcctctctaaacactcacacctgtaacatctgtttatctcagttgattcttggtgatcttagccatttcttccattgtatggccaccctgtctagtgttggatgactttgaggcagaggagaatgacaatgaaattgaaggtttgggcattttcgtcctaagggaagaaaggaagcatgttaataatatcctgttttagaaacacaagcagcctctgtatgcctgaatcattttagtaggttaataaaccctaaagtattgctctattaactactgtctttactctgccaacatttaggatttgaaaacattaaacccttgtttacatcctctgtaagtcagcattgatttgtttctcttctgggattcagttaaaagcagtgcttagttgcacacacattttacaaaactgaactacacaaaatgatttaaaaatacaaagtaaaattcctaatccctcaaaaatgcccctgatcgtaggcatacttcataatgaacaatccagggttccataaaaattttttttgttattaaaaaaaagttactttgttctctcagaatacaaactacagcatgagcgttctccatagggtttagaatgcggcttattgctttaatgggttaaagttaaatctttcttttcagtagaaggcatgccctttaaatttcttgccaggctaagtgacacatgagacaatttatatccactaagatttcggtaacttgatgcaatagccttggcaacaaaattctaccaaatgaaaagcatcaaattgcgcagaatggtgttcatagccagtgggtctccccatcgacttccctgggaattgtgccaaggtaaaaggctttagagtttccattggttataaacggcagctttttgagctctctttagactaggaaagttgattacctatagcaagcttctctgaccaacactggcaaccttgagaccactctgaatccatcatcacaaaagacctgccacatattaattacggtataactcctcttctgcataattctccttctctctaacatttccgtgcttttctgttctgttttctgcttactctttctcttattcacagtttcccacctcctcccccatgcagaatataacttgcataaaaatcacacaagtagtcaaggggcaaagtcaggagctaacatgttacagaagcaataatattgcctaagggcaaaaggaagatttttttttttttaggccatgtcttatctaagccagatagttgagcattttaatacaaattatcaaaatagatgcataactactacccaaaaagcatatgggatttagtataaaaatcaatgacctttgtggacatagaggttaaataacagatataattactttttaatagaaaagatcattttttctgtttgtgagacataaaggaagggcatgctgtcagataaaacaatttgtttcagctgatctcccaagagactgccacaggcaaaagacatagccggtagagtacccgtctccccacccttctgctgcacattcagaatggcagcctgggaaccaggggcatcaccaatcagcaacagtgaaaagggccgcaaaacccacacattttcatttccattgcatttattctagttaccttcactgataaacagggaggtgaaacaaagctgttttactgttgtttcactgtgatcaatccagaaactatgaatatactgttaagaataagcttggcaggtgagcttcaacacgtgaaagcatctcagttctcaacaaggcaagagtgacagacttgaagagttaggcacagtttattgctgagataataaccaagaaaatgccgtctaataatgacggtaatacttaagtgcttactactcagtgctacagtgaaattgatagtactcttattatcaccatccccattttaaaaatgagaaaactgaggtacaaaaaaattacatacaattaatacaaagtcccacagccagcaatacacagcttagctggtattgaacctgctccaaggtcagtgctttgaaccattaggccatggttctgttaagctttatgaaacttctgtgcctgacaaacaagattaaatatttgcaaatgctctaaagctgaatagcatgatgccaagaaaggaaatatgaaatatttcatttgagcaaggcataaaacaatgcctttcaaaaaaataagccaaagatcatttcactgctttattgctttgtaaatattaattaagcctccattctaaagtcctgcgatttaattatgaaataatatttttcttctatctcagtacaattccctttccctacattccaacacagtcctgaaaagtgaacaatttcaagattaaacctctattcttgatattgaattaagtacacactattaagtagacatgactttggattggtacctccttggatttcagttatggagggaaagtggaagctcttagggaggcttcatgacactttgaacatgagcattcctgaactcagaggcgacagagccatttgtgctgtgagtggattttggaggagtgccaaaaagacctggcaggtaacaaaagttggtaacactgagggcctcagttaaaatgtgtaagaaataagtaagaattaatgtcttcgtaaagataagctaacctcagcttttatactgcaacgagaataggatccgagacccacagaaccagaaattagtccttgctgtctaactaggttggtgcagtggctcacacctgtaatcccagcactttgggaagccgaggcaggcagatcacttgaggccaggagttcgagaccaaccgggctaacatggaaaaactccatctctaccaaaaatacaaaaattagccaggtgtggtggtgcatgcctgtagtcccagctactcaggaggctgaggcaggagaatctcttgaacccaggaggcagaggttgcagtgaaccaagattgtgccactgcactctagcctgggcaacagagcaaaacacagtctcaaaacacacacacacacacacacacacacacacacacacacacacacactgtctaactagaggagaggagcaatctctcagttcttcatcttctaatctataaaacaaataatggactaaacaatggttgctaacctctttgataatctaacagaaggagtccctggactcctcatcctacaggttaaaaacttgtagattaaatccctcaatctctttacaatgcctacagtggtgatttctgttcatttgcaatactgagaaggtgagatacagtgagtgtatttccttggttggcaagatggcaaggccagcccagaacattgaaagatatggaaacagcataagaaggaaagtcaaaaaggctactgggctagttaggacaggcactctggaaggagggcagtcactgaggagatggctctgctctgtgctgaaggcaaactggaatgaactgacaattttgctttcaggggagggggtgatgaagagttcagttttgttctcctgctttagtgtactatgctttatacattggtccagactatctaatcaggatctcattaagggaaagcttagcattgtttgagttctctttcacacagcagagctaaaagtaaacagcggccaaagataaacaaggagcattgctttttcctgtgttgtacaatagttaagtctaatttattgacaataattgttggtagtataaatactgaatctgagatgaactttgcaaagagcctgctggtttttaagctttaccaagccagcagactttcttttgttgctaagggaatttttttccaaatcaggatttcttaaatagcaggctttgtatgctggaagacacaagtgacccactcactactgagatccagctttttttttctttctttttttttttttttaattctttaaatcaatgaatggctgaacttcaacttttctctgctgttgtttcttataaaagaagtagataagatagatttatgagcaaagaatagagcttctgcttctgaatcctcctttggggtcgtctgagtcatggtttaggaaagaattcctaccaaaatccctgaaacaatggaccaattccactattccctcttctccctcatatccagctatccccataaacccagagagaggacctgaccccgtaggagcaaaggtgccctggattatggtcctggtttgtgaaagaaaattgcatttaccaatatctgcctcacagttctttcttgactgattgcttatttactcctggctatatttacaaaacacttcaggccgactttgatatccttaaagttggtcttgatatcttttcattttgctcttttttgtccggcccaatccacaccctgccctaagcatattttctcagtaatgacgcccatttacacatgaccagacttatgtaatttactagatctatcctagtcatgctgcactatcttgccctcctccagtttaagacatctctaccatcaaggaccagcctctttaaacacaatctgttccaggcagatttatcatgacacccaacatgtctgagccaaagtccaagtgaaaacactagactctgtttttttttttttttttttttttaggagtcttgctttgttctgtcgccaaggctggagtgcagtagtgcaatcatgtctcagtgcagccttgaactcctgaggtcagggagtcctcttgcatcagcctcttgcatagctaggactacaggtgcacctcaccatgtggctaagttttttttattttacatggagacagattttgctatgttgaccaggctagcttgaactcccaagttaagtggtccttccacctgggcttccaaaagtggtagaattacaggcatgagtcactacacctggccaaaacattagaacttttttctttagggtttttaaaaagaaatgtatcaaatgtacaattccactccacattctactccttcatattatgaaagttggtgtatattttttccatctatctttttatattcttcatgaactacataaaaaattaattgatggagcgagactccgtctcaaaaaaaaattaatttatgcagatgtacctatccttcagcaatttgcctgtttaatcaatataatgttttagatgtgattccaaatgatatgcataactttagttgactcacttaaactattactttcatgtcaaggtatgaatatgatacaatttatttctctatcagttattaatagaaatttagattttcctgaatttttcattgttataaacagtagttcaatgaacacatttccatatacatatgtgcaaagtttctctggaacatgtaactagaaatgaaattgcttgacctcatgtagatatatcttaaatattagtagacattgacaaattactctgaaaaatggttgcaacaatttaaacataaccagccatgttgaaacatatccccacagcttcaccaacacatggtgtcttgctctttcaaatagttgtccaacaattttttgtaatcggttgtttattttttcttattgatttgtagaaattttatttatttcatgaatataatcatttgtcaattaaatacattgcaaatatctgcttctagttttccttgtcttttaaattccatatatcaaatgaagtattcaagtttgatacagtcatattaaccaatattttccttaactcttgattttaaaaaaatcacctacagtatttcaatgtcatactctcttacagtgttttctaaactatttaaagttttattttttacacttagatattctattcatctggaatgtattttgtgaatggtgtcaaagagggatctactttttaaaaataataaccaattgtctcaagagcatttattaagtaatatctttccccatttacttgtcatatactaaaattactattcacatgtgggtaagctctctcttctgttccatttgattatccctgcaccaacaccatactcttttaattgttgtatgatatttctcctttaatctgctaatgatgagattatattgatagatattcaaatattaaagtctttgaaatgcttagataaaccctttattttagtccactcttggattcaaattattatacttaattcagtttttgcatgtatattctaagtaaagcaggtttataatgattctttctcatatgtttttggtattttggtatctaaattatgataacataaaaaatgaagtggagagaaatggtacagtttttttaagatggagttctttgtgtgtaaagatttgtttaacttttgctcgtaaaactttattgattttagaggtgtagggtgaattttgactctaatttcttcaataatttttggtctagccatgttttctatttttattgagtcacttttgagagttctttttatgtttcatcttgtataaaatttaaattttatgatcatgtgtagacctttttatacttaacacaatggaaatgttcatatttattttttccccaaaggaaaaatttctgaatcatcactatgttgcacagtagaataggaattcaggtacttagtcaagttaagaatgcaaataacagacaagattaacttctaaagtctgaagtcatcaacatgattttgtagtactctgtctcaggctttacctaaaaattcattattattcagataaagataccccctaattacatgtttttgaaaagcctctgccccaccacaatttcctgagatctgtgaagaaactgcagtcttgtgatcagagtccatatagtactggcagttttgtaatcaaaggaaaaaacgtcgactgattttatatgtcaatcagttgtagtctgctgatctgattagaaaccttgacaaatgcctggtggcgattgcaaataactgccaatcatatagggatgatacagtagctcagtgttttgggatcagctcttgtacacaagtaaaagaacagaaacatctgtaagtaaggtattagaaaaataattgtccacaaccaaaaaggcaagaagagtaatcgagatttccaggagtgtgtccatgtggttccttcaaggggctcctcaggttgctgttgaatgtgttccaaggccagcctgttgtaagtctcattgatttcaaacatagtaaaatgctgctgcacttgctaacagatacaatcccactccaatctatctcatccgctgacggaagttcatcattctgcatgctctgtgccatggtcccgaaaaccttcctgttcccatggccagcattaaagagtcactcaactctgaataatctggtggctttggcatttcagagaaagccaccataaagtaaatcccctgggtcaccaggctgggagaaaggtctggagcaccagctactagtgattaagaaccttgtgactgtggcaggtcacaccccactcctgagagttctttttagaaaatagtttataatctaagtattcaaatatgttagcataagatgagtcatattattttctgatacctgaggttatgtctcattgtttttgtgccttccttcttcttatgatcaataatgccaaagattgttagtatcttttcaaagaattagctctttaaacacttatatttcatttatgtgatcaataaattttattaactgctatataccagactgttctaactaattgggtttctttttaaaaagtaaagagtaaactaatcctagatccctgcgcttgcggattttatgaggcagagataagttgttcaaaaaagaaaaaataattaattacgtgatatattaacaagataataaatgctatgaaaaaataaagcagagtgaggagaatcagaagtgccacatgttgggagcagcatgcgggctgcaattttaaagaaggtgggcagaaatattattgagaagatgagatttgagcaaagatttaagggaggcaggaaagttagccatgtgagcatcccggaagtaatattcctggtggagggaacagccagtgcaaaggccctaaggcgggagcaagctgggcatgtctggggattgcaaagaggccagtgtggctccaatagagtgaatgagagggagaagagagaagtcagaatagataaggatagtgagtctgagtttaagaaggctgtgggaggaatgacataatctgatttatagttttaaatataaacggaagcagagtagaaaagttatgatgctattgtgatgtaaaggcaaaaaatgataggcgtttggattaaggtggtaacaactgacatgtaatggtgaatttagagtcgtctatctctgctaccttcatttgtctttatttcaccaatattggcttatatcattagtattgtcttcctactttctatagttgagtcattaaccaccttgtcttatctgttttgttctgctaattataattatatatatattttactaagtctcttaattatataatttattctttctttgccttactaagtttttgtttttctcaacttaatctgtcagtttctgaaagaaacaaaatctcccattatggttttggatttgtaaatgttactttatattagtgtttgaattatatattttgaggctgttttctcttagatgcatatagatccacattgttatatcttccaggggaaatcattttttgagcctttttaaatctctatgaatgttttaaagacttactttgtatatgatttcctattagtattagtaccccagctttctgttctgctgtggcatttcctggccatttacttcagacttcaagcgtcattcgttattttaggtaaatcttatatagcacagatctggatttgtttatatcaaatctagagccctgttagttagtgggttttatacatttacagttattttgattgctaataaactttgagttatttctactatcttactttgtgttttctatgaactgagctttttgttaacttccttttttactttccttccattgatgtgattaaacactccactttttgtttactaatttgtatggtttttaaaatacatatacttaaaaacattttaagttaataatgtctttaacttgttcttgaatgatacaaggacctttatttccttgtgtggcttataatttttttattataagcatggctagagttttctataggaattccttgtgccctttgacggggtcctacatgatttaaagattccagaccagttttatgttactttctcagcttcatgttcctgatctctgtgaatagtgtgaatttggatgtcacatgtacatgggacaaggtttgcagttcaagtttctgactgttaactatttgccagtctcccagggcagtgagcaaagatttttctgattccctgttcatgattttggcagccattcatggctcctaggtctctgcatgtaattcagtcctggcaatgtgcaaacagggccctgacacctcctcacaggcattaaactttgcccttcccagttctgattctctgtgagccgcaggacttcagtcctattacccagtgtgacattttgttgtggctttatttttggcacatgaggatttatgattccaaattttgagttacactataaattccaaattgtattattcttatttattttttaagcagtttatttgttttgagcagggatgggggattcttacacatcagtactgtcaaccatattgacttgaagttcatctttcacatttttacatttaacagatattcaaatcttagtgattttttatattctgaatactgcattattcagagacattgttcatttaacatttctttttctcttatttaaagtcaccaaatattttgatttctttatgtaagagaaatgaagcatgcagaaattcctaaccaactacagttttgtgataacccgattttttctatagatactaaattttaaaaaatttaaagtttgtatttaatgtgattgctttctgtcctccaaatcttccaaaatatagctggaagaccaaatctagtataggcggggaggttacctaagcattttgctgaggcttgtgaaaaccagctatggttagtctaactacaaatgcattacatttaattttaataaggtttggtttacaaactttaagcaggttaaagtctacataacacagaactcatggaaaaatctgcctcactggttagactgaacaaagtttccttaaaatttgaagagagattcaagaagggtaatatgtcatggtagattattaacattaataattctgttttattttagaaaagaatgtgtttttagaagttttattcttaagtactacatcctcctaaagtcatccttccatataaatgttttgagagcttggcctaattccttatcacaagaaagtcagggcgtacagtgtcctcaccagtatctccatggaaacttgtgcttcgaatttctgctttccctgtattatctctctccactcttgattctagcttctttcaggtgttttcttctctctgtctcttatccacacagacatgaaggacagactccttttgtttttttgcatcctgccaaattctaaaagtacaagtcagagtgacaagcagacaaaacagcataatgggtgttttggtggacatcctctttatccccctgttatgttgccaaggctggagtgcagtagcatgatcatagcgcactgcagcctcaaactcccaggtgcaagcggtcctcccccttcagccttcccagtaggtaggactacaggcatgctaattttgttatttttttgtagagacagggtcttactcttttgaccaggctattctccaactcctggcctcaagcaatcctcccaaagtactgggatttcagatgtgagccgctgcatccagactaacatccttatttttaaagcttcctctgtcatctgtaacacagggacttttgcaatggctctgtttctccttccagccctatacttcttccaccatccagcctgccaccatatgttgtatgccatcaacccttttttatgtccttaattctcactgcctccctcttgagctgcctctggaaagaaaccaaattttcctcactttctgttgaaaagcaaatccatcttcccttggtgtcaccttgtctttgtcttgaggcccattcacttacttcccaatggactattaaggagttttgctgaacaaattatttccccaagaagaattctgtttataagattttaagataacattttcctcttccccaatatattttttagaatgatttttcaactctttgcttaaccccaattttctgaaatgctttgatattactaacttaggttttattagataatgaaaatttcaagaatgtaattcttgtgaatggcaaactattagtttatatttataatatttactaggctaatttagttagagcaaaaggaatctaaaaatatcttgaattgagaaaccaatgtagcttggatatgaatgatatagatgaaatcatgtatctgcctgcctagtttcaaatcttcctctatcacttactagctggtgtgaccttagacaagttatttaacccctctgttctttggtttcctcatctataacatcgaataataataataacaataataatctctatctcatatggatgttgtaagtaataaatgagtgtgtatatatatatatatattatatatatatatatatatatcttacaacaatgcctagcacctggtaggcactatatacatgtgtcagctaagatttccttacttacacacagaatctcaagaacaaaaatatgagataaaggaagcttgacagatgagggttttagattaagtattgtagatatgtgatgttaaaaatatacttaatgaagaaatcattatgtttaaatgtattctaatatacactaaatgaattcacaatatacttcacataaggaggtaaggcatgtatccttaaacagctcttggtatttttttctggctccttagaaaatctggtaacagtaacttaactcatttcaagagctatgttaaagctgggtatggtggttcacacctgtaatcccaacactttggaaggttgaggcaggaggattgcttgaagccagaagttctagaccaacctgggcaacaaagcaagagcctggtgggcggatcactaggtcaggagatcgagaccatcctggctaacacggtgaaaccctgtctctactaaaaatacaaaaaaaaattagccgggcgtggtggcgggcacctgtagtcccagctacttgggaggctgaggcaggagaatggcgtgaacccgggaggcggagcttgcagtgagctgagatcgcgccactgcactctagcctgggcgacaaagcgagactccgtcttaaaaaaaaaaaaaaaacggccaggcctgcgggtgagcgcctgtagtcctagttgctagagaggctgaggcaggatcacttgagcccaggagttggagtctgaagtgacctatgattgttcaactgcactcaaacatggacgacagagcgagaccctgtctcaaaaactatatatattattaattgtttttaaaaggaactatgttaaagtagtgattacccaggggattcacaatgcccgtgaagcacattcttatacctcagattaagaatccctggcttaagagtttctggcaggaaattaaatgcaagaaaataaaaataaaatatttttaaatgttaaagattatacaacttagatgacctttttgttgccagggactctgatggatctgaaatactaccctacttgctagctaataagttagcctgccacagtttcatggatactgacagatatgaacattctgggtcagagacaaagcaattttatcattcatggcatagcaagcagcactgctccatgttcgtatcagttctccttgccccaaagacccaggcaggcaacacaaaggagcccaggtgattgctgtgcatgcagtggacttgcatcacagctgaggatatccaagtttaggaaagcccaatcttttataacaggtacaagcaaacatgccttatcttttcagtagaaggacacgtcttttttgtactagacagtaagcaaatctgctgtctgctgtagaggaaagcaactgtgtctgtcctccaaagtggatcatatattcttaaaaaaaaatagtccagaatgaaagctgtcagtgcctttgcttgcaagccatgcagaaacaaagaaaaagagttgtcttccaatgtttgtcccatcaagtcaggaagggaaaatattatcatatattagttaggagaggggggataaagttagttatgtggatggaaagataactaataatctcttcactgtaatcaggaataagaaaagaacaaggtatatgtaatgtttgccttcaaggagctaacagtctggtgatagtgacaggctttaaacagataagccataaaaagattatttgcaatttagataagtttcaccagaagaaatgaagatttatgaaattatatattcgagggacttgatctagtttatgatatcaaagaaagtgtccctgaggaagtaacatttgaaaacaaggcctaacagacagagtaaagttgagcatctctaatcctaaaacccaaatactacaaaatccaaagctttttgaccaccaacatgacatcacaagtggaaaattccacacttgacctcatgtgataggccacagtcaaaatgcagtcaaactttgtttcatgcacacaattattaaaattattgtccaaaaattattgtatgtgtataaggtatacatgaaacataaatgaattttgtgtttagacttaggttccatccctatgatatctcattatatgtatgcagatattccaaaatctgaaaaaaatccaaggtctaaaacattttgggtcccaagcatttcagatacttcacctgtggtaggaattgtcaggtgaagagtagggaaaacaatattctgggtagaaggaagaccctattgaatgaaggaaccctgtattattagagaaactacaagaaagcgaggattactagagcagtgtaagataagcaggagccagattgggttttggacttgattctgatggcaatgcaaaggcagtgaagggttaagaaagagaatcacctcattatattagcattttaaaatgcccctccattgttgtatgagggatttgttgtaggggaagggtgaatgcagaccttagagttaagagcttgttgctacaagcccagcaagagttgatagtgctctggctacagacagtggcagtgtagatgaagagaaatgaatggattcaaaaaatatgtttataaagtgtagttgtcagacctgggtgattgatttcatctagagggagaaaaagaaggtcgtggatgattctcagatttctggcatgggcaactgtgcaggcagagtgcctagaaagaattaactagcctcttggggatttatctcataaattcacttctatttcagtgacagcaagcatcttaaatatatacacacagggaacctgattctctccagagccctaagaactaactttggtacagataaaagatgagctgtagggaattgagatgtcacactcacctcaatatacaggtagtttttacttgaattcattgaagaaagaataccattgtgctatcagttggttaaaaattgcacctcaaattttcctaccagtatgatcccttttaagctgtataatttacactggggtgtgatgccatcattaatgctccccatgttgattctaatgaggagtatgtccttttctcattctgagaaaagtatgctcttactacccacagatattctgaatatatagttgatattcaaccatatcaaatattgaacctggtgcttccaatatataagttattccttaggattaagaaactactgaaagcatttccttggagtatttaaaacgcagctgacaaaaatccaactcaagctagcataagaaaatgtgtagctcatataagtaaaaactttcagatcagggtaggactcaggcagccatagatacccaagatgttttcacgctgttgtcctgctccatgacttcctttctggagtcctttgttaccttcgttatcggttaggctttcttcatgaagtacaaaaggaagtcactggtagctccaggcctacacggtccatctgatttcccagtggaaaagtgtcttgcttcctgaccatgaaaacagggaagactgtttgagtcatgtattcacctctgaaccaaagctctgattgtccaagttgggtcacttgcttgccttggccaggctaactggaatcatatttggttctggttctaatctgttctccacaagaagaggggattttatcccagaacatggggaaataaagatggatgggcatgcaaacaaacaaataataaatgtccacttccgataagtaaattgggaaagagctgaaacatcacagaatgatttcagtacaggccagtgtagaattgcagacgtggaaggttaaaacaaggtacattgatataagatgaaggaaagataatgatgcagtaatatacattaaaagatggaaggactgtagtatgttgcctgtgaatcagcaggtgtcaagttttgaaaacaaagatgtacaaggatgaataaaaagtatgtctagaatatgggagtggtggtttaatttggctattttactactcttaaattagatctttgtatctgaggtggaactcctcagctaaagaaaaatgaaaacaattggaaagagccagaagagacctatgaagatgagtaatgggtagaaaataaaatttaaaaatcaataaatatatatgtagtgttttgtccatgcaaaataaagccctttgaggaggataaaatgtagaaaattattgtaatagcaaaagagaaatataatgcttttacatatatggtttcaattcagaaaaaaatgcagctatttttctctttgcatccatactcaaaataaaacagaataaaagaagttcaagcaggtgcacgaaatatttatatgagagataaatatttttaacttggaattaataactgttagaatgaatttcaagccttctctgagatcttttaaaatagagttccttctcatatgtttgggctgtggggcactgtactgctcaaaggtaaagtgaccagttagacgactatatgcttcatgaggacaggaatcctgtgttgggtgaattcacatctgataggctggagcataatggtctctaaaatatttgctaagtatgtgttgatgttaatttgcatttcacttagttgttaattatatatgtttggaatctgctttatggatctgcttaacaaatattacgtttatattaggtggtatcatcatacatacatggcatcatacatagactgccaactttctagctgctgtgttttcagtgaatagaagctagatgtgctaagtaaaagatgatgacaacaagatactgatagaatttccagttatctgcaattttggatcatctgatccattatctccatctattatcaactaagcattcatttgaagagtaattatggaagatgaggtttgttaatattataagttatactgaatacaaaggacaacggtcataacacctttatgaatagactcaatattgcatccaggtcatcatggaattgagcaatagaatttaggttcagtaaagaaacttaaggaccatcttctacccaatcttctcttcttctctagttatctcattatttaagtgatgatgtgattgaaacctaactatgttaagagacttgcccaattacactgttggtgggagtgtaaattagttcaaccattgtggaagacagtgtggcaattcctcaaggatctagaactagaaataccgtttgacccagcaatcccattattgggtatatacctaaaggattataaatcattctactataaagacacatgcacacatatgtttattgcagcactattcacaatagcaaagacttggaaccaacccaaatgtccatcagtgatagactggataaagaaatgtggcacatatacaccatggaatactatgcagccataaaaaaggatgagttcatgtcctttgcagggacatggatgaagctggaaactatcattctcagcaaactaatacaggaacagaaaaccaaacaccacatgttctcactcataagtgggagttgaacaatgagaacacatggacacagggaggggaacatcacacactggggcccatcgaggggtggggagctaggggagggatagcattaggagaaatacctaatgtagatgacgggttgatgggtgcagtaaaccaccatggcacatgtatacctatgtaacaaaaccgcaggttctgcacatgtaccccagaacctaaagtataattaaaaaaaaaaaaagagagagagagagacttgcgcaatttgaaataacctctttatggcagaaactgaaccaaaacctacttgaaagaatttcaatttcctgaagctagatgagagttttccaaggcctagcttaacatcaatattaatttcaattggtcaatataatctctaccttcatatcatcttgagactcaattggttggccattttcatgatgctttaagaacaaactcaacacagacattaaacacatgcatattatgttagtttttccttatctatatttaaggaaagtattatatttgaggagaacttaggggatgtggctaaaattagccctccactaggaagtatttttgagtgtgaagaaatgtggaagttatttaactgttttacagatgttttaaacttgaggctcttagttttattgatttactgtgatctaattaatccattcaccactgaccaaggaagtcatagtgattcagttcaaaaatctccccaagccctgcctgaacttctctgaaatcagtagagtagttaatacatgatgaaaagattgtggtttgctacagaaaattatctttatcttaaataataaaaacaatcaaggtgtcataatggtgggagtcaccagcaatggtaatgaattataataaatatcacagtacagttgatatattaaaaacaacagctttcttacagccaccaagtaaactgttttatatcatttacagctaggccagagttgtcccttggacataaggagacatgcctaccttggatgttcaaacaaatgttatattgcctaagcaggatatgttcaaggttttagccaatcacattgcagacagctatctttaaatattaaaggttatttcaaattgcacaagtctctctcttttttttttattatactttaagttctgggatacatgtgcacaacctgcaggtttgttacataggtgtacacgtgccatggtggtttgctgcacccatcaaattaaccatcaggataatttaatctgaattgagtttcagtattagaaaatagagcagccttttaaaaataatgccctccacattagcaaacaatctctgtcctgtttcctttatgcagttataaaattatggatgtcaggattttaacaaacttgtgcttgtagacccataaatgggaggcaccctagaaagcagcctccatgacagtttcacatgtgattcagagtgctgaaagggttcactgtttggcttcaactctttattgagatccttaaaacttaatttctgggtgttttttttttccttcacaagagaacaaacaagctatatttcgagccagtagtaaccccaagcatttttattaatgtttgctcagcaacagtctgagctttgtatggttgctttatccccagttcactgtgtatcagcaatttcctgttcaccatctgggaaagtcagatgtaactcttatgagaagaggcaccaacgtttcctctgtacttcattatttcagatgtaatcaaaggagtaaatctacagtgtgttcttggctgtaatacagtggagttgtccattgtctggatacaaatccatttgtgttcatcttctaaaggaaactcttttccagatacagttctgttaaatactatatcaatacttaatgcttaaggtttgtcaggttcaagctgataaaccctacttttaaaaaacctaatattcttatatcttgatggtgatactcttcggggctctagaggttcttgctaccacttttgtaaggagacattgctcagtgcccagccccagcagcctttttgttcagagaagcagtgtgcacagtggttagagcacagactcgggagccagaccaatgcttgggttcaaactctggttctgcctcctcctaggatttaaccttgagaagttaaataagctctctgtgcctcagttcctccatttataaaatggggattataattctagtaattacctcttaggattattgtgaggattaaataagttattctaagtgattactgaaaagagtgcttagcacttagtgggcaatacttaaaggttagatatttgtatagctgctcttatctcaaggatttgcatttgctgtctcttctatctaggatgttctttcagactccacatggtatgccctctccaaatgtcactcctcaaataggcctttcctggtcatctttttcactgttcctatttgctgctttattttttttaaaaccttgaccaccatccaatattatattttatatttattttatattttgaactccctgtttcttcaaaaagaaagcaatctgagtgaggtcttttgtataagactgtatacttggagtctagaacagtgtctggaatgtgtataggagatactcaacaaatatttggagaatgaatgaagaaattattatagaaagatatttatattagaatgcatttctgtagatgcatgaatctctctatcagaactctccagagcacaaaataatcacaattactacaagataaattagatcttggtttaggctgtgcttgcactgaattgaacactaagctcatatgaaacacttaagattgtctgcagtgattcacaacataagcctgatattttagtttgacttctcaaagtcagttatattttcagtataaatgaagtaaaacatacacttgaaactgaaaaaaatagtacaagtttaaagatttaagacagttctctacacacaaaaatgataatactttctatcactggtcaagaaaaagtcacttttttaagtagtaatcacttgtgtgcatttttttcagtattgctattaaaagaactttctcattttcaattttgaatcattcaacaatgaaatgttagagctgttgccttgctttaccacataccacagggtaaaatagccaaaggttgtttaagtgggttaagtaaaaatggagaatgtcagtaaaatggaagacctcctaacccacagcagaattgcacttgctttgatactgttatttcaataatgtcaaacaaaaatgaattgactttgccttttgaaattttatttaggtacacgctgtcagtactttaaagataaaagaataaatgtttcttctttcttgaacccttgttatgtaccagtatgcttagcattgagctggatacaaaaatgcataaagttctgttcttgaaaagtttatagtctgtttagagcaacaagacaaaaaacctgtaagaaatcagtacatatcagtaaatcattagtttctaaagaaattcagatgtaggaagattattgtgggtggttgagaacacaagaagagagtgatgctttgccaagcattaaaggatgaaaagcattttattaggtaatttggaaggagaagagaacattccatgcatgaaacacagcctgagcaaagataaaaatgagcaaattataccagacattcaaaaagaagaattggcaccattactgttgacactattccacaagatagagaaagagggaatcctccctaaatcattctatgaagccagtgtcaccctgataccaagaccaggaaaggacataaccaaaaaagaagactacggaccaatatccctgatgaacatacatgcaaaaatcctcaacaaaatactggctaacggaatccaacaacatatcaaaaatataatccaccatgatcaagtaggtttcataccaggcatgcagggatggtttaacatatgcaagtcaataaatgtggtatgccacataagcagaattaaaaacaaaaatcacatgatcccctcaacagatgcagaaaaagcatttgacaaaatccagcattcctttatgattaaaactctcagcaaaattggcatacaagggacatacctcaaggtaataaaagccatctatgacaaacccacagccaacataacactgaatggggaaaagttgagaactgcaataagacaaggacgcccactctcactacttttcttcaacttagtactggaagtcctagccagagcaatcagacaagagaaagaaataagggcatccaaatcagtaaagaggaggtcaaactgttgctgtttactgattatatgattgtttacctagaaaaccctaaagactcctccagaaagtttctagaaccgataaaagaattcagcaaagtttctggatacaaaattaatgtacacaaatcagtagctcttctatacaccaacagcgaccaagctgagaatcaagtcaagaactcaacacctcttataatagctgcaaaaaaataaaatacttaggaatacactaaggaggtgaaagacctctagaaggaaaactacaaaacactgctgaaagaaatcatagacaacacaaacaaatggaaacgcatcccatgctcatggatgggtagaataaatgttgtgaaaatgaccatattgccaaaagcaatctataaattcaccacaattcccaacaaaatatcatcatcattcttcacagaactagaaaaaacaatcctaaaattcatatggaatcaaaaaagagcctgcagagccaaagcaagactaagcaaaaagaacaaatctggaggcatcacattacctgatttcaagctatgatataaggccattgtcaccaaaacagcatgatactggtataaaaataggcacatagaccaatggaacagaatagagaacctagaaataaagtcaaatacagccaactgatctgtgacaaagcaagcaaaaacataaagtgaggaaagataccctattcaacaaatggtgctgggataattggcaagtcacatgtaggaggatgaaacaggatcctcatctctcaccttatatagaaataaactcaagatgggttaaggacttaaatgtaagacttgaaactataaaaattctagaagataactaacgttggaaaaccccttctacgcattggctcaggcaaggatttcatgaccaagaaccaaaagcaaatgcagtaagaacaaagacgaacagctgggacttaattaaactaaagagcttttgcatggcagaaggaacaatcagtggagtaaacagacatcccacagagtgggagaaaatcttcaccatctatacatctcaccaaggactaatatccaaaatctacaacaaactcaaacaaattagcaagaaaagacaaacaatcccatccaaaagtgggctaaggacatgaatagacaattctcaaaagaagatatacaagtggccaacaaacatatgaaaaaatgctcagcatcactaatgatccgggaaatgcaaaccaaaaccacaatgcaataccaccttactcctagaagaatggccatgatcaaaaagtcaaaaaataatagataccggcgtggatgcagtgaacaggaacacttctaaactactggtgggaatgtaaactagtacaaccactatgaaaaacaatgtggtgactattgtagaataaaatagtactgatctgggagttcaaagatctgaatttgcgctctagttgccacgcctagtaactgtgaacaaatttcttagtcaaacagttcccttattgttataaaaaagataatatcctttatttttccataatttttctctttacatgtatgtattagagttctctagagggagggacagaactgtgaggatagatgtgtgtataaagagaagtttgttaaggagtattaactcacatgttcacaagatgaggtcccacaataggctgtatgcaagctgaggagcaacgaagccagtccaagtcccaaagctgaagaacttggagtctgatgtttgaagataggaagcatccagcatgggagaaagatgtaggctcggaggctaagccagtctcatctttccatgttcttctgcctgcttttattctggctatgctggcagctgattagattgtgcccacccagatgaaggttagggtctgcctttcccagtccactgactcaaatgttgatctcctttggcaacaccctcacagacacacccaataacaatactttgatccttcaaacaagttgacactcagtattaaccatcacagtgtgactaatgtgttaggattcatgaggtctaatcataaagtgatactattttgtcactggttgtttctttataatttattcaatgaaagaagtcttctgccactgaataaaaccttagaaaacttcttgaaacctctaataattctttggaaatagaaagccttgtgattactgtaaatcacaaagatagtcttgacgcaattatttaaaaatctagtcccatgggattgtcaaagtagctaactttatttagttaaaactactatccttccaacagcaaggacttactaaggcataaagtttatgaatagggaagagcgtgtggttagcctctttttccctgcctctttacacttctgctaattaatctttatttctgtctcttctgggttggaacatggggaggaagaatatggaagagaggcaggaaaatactggcacatttatttgattggtactgtcataagttggctgccatcctctggacagttgcttatgatttgcacaatctctagcaactcagtaccttctgcctgtctctgctgaggcctaatggcccttccagaaggttctatcagacaagaactaggatcatattattctagctttctcttgtgcaatgtaccagataaatctgtgcaacactttggcccaataaacttttgaagtgcaagtttacccaacctaaccacctctttttctagcctgctgctagagtagcaagccagcctctctctcacactggagattttccaaagagggtcaaaaccagaactcttcatcccttcccctcagctccaggggacacacagttacttctacatagcacaattgtaggtatcttgttctctctttttcctatacaagtgcatgccaaaaaaataaataaataaaactaatcctttccttttctaaactttctttctctctttctgactttctttctctctttcctttgacatgtaaagatatctagcctgttctcagccacgtagtttcacaagttgctctgatgctttctgtcttccagcttacttcgatacctgatgccttaggttcttgatcaaaacttccagtttaacagcaagatctatcaatttttgtaaagtgacttaaataaatgaaagtcgcaaaaaagatacagctttttttgcatcttcagtagttaggcaacactaacagaagtttatttgactctagttactttgcctacaattccattaagtcacctgtagatgggtgatggtgaccggattataaccaatttatctaaaaacccaggcctattggtgtgactttcatattgcagcctatatttatcatgcattctgcttttccttaaaaaaaaaaaataaaccaagaccactgaactgaaccaattgataattatccatgttaacaaaatatatcttaaaaagtgatatggtttaaagatttaagaataatttctaggtaaactagtaaacctttctcctttaccctagagtttatgtgacacagcactggtttattctcataaagcttgtgtttgtttatggatttgtcactggtttatccccataaattcacatgtttgtttatggatttgtcaggccaagtctctgtttaaatgcattgtctgatgatccaggatgtctacttcattcttttgaaatagttaagtctaggctcagtggaccttacagttaggataacagcagattatttcagcattttaaaaaaagtcttaaaactttccatatggtgatctacttggaacaagttagcccatttggaataaatgattaaatacttaactaaatacacgaattttacactaaatggccatacctggacacttgttgccctttatattaattcaaaatcaagacaaatattatcactcaatgtaattctggatagcttgtgtttaggcaaacactgggatttaagggatgactataaccaaatgaaatgaattttcataagaaaaatggcaatctcagacaaatataaagctcacataaccagtgtatcttgattatttttgaagggggagtgctttagatgaaagaaacaaactggttgtaagcaagaatgacaatacagtgctacgggttccacagggccaactttagggcttgagcatccttagattttggtatctgcaggaggccctggaatcaatgcaccacaaatactgagggacaactgtatgtgaggtttggaaacacctcataaaaatttacagacttatcagttatctaatgcaactgttcctctgacatgagtcatgtgcgggcctgccagggagaattccagatgtcctcctccagatcctgctggtaaggaattagaaaaataattaactataccaatctgggtacttgtgctgacactaagggtctacattttttggaaataaagcattaggactcttttccagttggataaggtattccttgggtggtatcttgacatttgaggactagcattaatttgcttgaaacaacagcatgttaataagaacactgcaatattaattcagtatatcttttcccgttgttctgaaagagacatcagcggtctagctccctgatttggtagtaggaaatctcaaatctcagtttggcttctaaatagtgtactttgtgcctctgaccctttcatataaaattaacaattctcagcacttcacaatgtccttatcctattttatttttccatcatggcattgttgatatcattatcaatatcaggtatagtatgtatttatttgtatgcattttcatattttctgtatttcaggtatctgtgttggattctggcttgggtttaaaagacagttttttgttttttaaaaaagtctttctaataacttagctctgaacaaggttagactaaaaagaatttgggaggctgaggtaggaggattgcttgaacccaggagttcaagaccacccttggcaacatagagagaccctggctctacaaaataaattaaaaattagccaggcatggtggtgtgtgcctgtggttccaggtactcaggagctgaggtgggaggattgcttgagcccagaaggttgaggctgcagtgagatgcagttgtactgctgcattccagcctgggtgatggagtgagaccctgtcttgaaaaataaaattaaatatttcaaaaggatccagacaaagtgatatccactagaatgtaagctccaggagggcaaggactttttgcagctgcggttgttcacttctctaaccctggagcctcgaacattttctgacctatagccaatgctcaatagtcaggaaggaatggagattaaaattaatgcttgtcttatggatttcttgtgaagattaaactaaagattgcatataaacttagcacaacatgagatacagaatccaaaaaccctaaaaggctccttatggcacccagacttttaaatgtatgaatttcatcccataaactgaagatactgattatatgcatgttttaaatatattcaacttctaaatattatacaggaagtccctgattcacaataattcaactaaacagttttccaactttagaatgatacaaaagcaatatatattcagtagaaactgtactttgagtacccatacaatcattctttcactttcagtatagtatttaataaattacatgagatataaaacactttattattaaatacgcttgtgttagattactttgttcaactgtaggctaacgtaagttttctgagcatatttaaggtaggctaggctaagctataatgttcagtaggttaggggtattaaatgcattttgacttaggatttttttttttttttttttttttttttgaggaagagtctcactctgtcgcccaggctggagtgcagtggcgcgatctcggctcactgcaagcaccacctgccgggttcatgccattctcctgcctcagcctcccgagtagctggaaccacaggtgcccgccaccatgcccagctaatttttttgtatttttagtagagatggggtttcacgacgttagccaggatggtcttgatctacttaggatatttttgacttaaaatggggttacatcccaatgagcatctatatttggcatccttgtttatgtaagtggacttttttacaatgatgagaacctcactctgatgtcattaacaattcaccttatgtttgctatataaaaacttctttcatataaaaggtggaagaatatcctgtttacgatattcattttagctaaccatagactgaagaccacttgtgactttatttgatctgtattttggcactatttatttaataattattacagccaaaactagagaacaaacttattggtttttcttttttaaaattaatctccttttctttttcttttcaatagttaatctagaggcagtgctccactttgaactttaagcaaatataagccttaacattagggtctctgcagtgagtttttataaggattgaagaaagggagctacaagaaataagacatcaaatcttaggttgtgtgatagcctgataccttccatgttttcttgaacatttcttctaaaaaaaaaaaaaagtgtattttagaatctaactttccaaaattgctttgtagtagcatttactgaatggattgtagtgttttgttaatagcactgttttgttgatagcactgaaaaaaatgaaaacctctgcatatttctttttttttttttttgacagaattttgctctgtcgcccaggctggagtgcagtggcacagtgatctcagctcactgcagcctccacctcccgggctcaaatgattatcgtgcctcagcctcccgagtagctggtattacaggcccccaccaccacgcctggctaatttttggatttttagtagagacaggtctcaccaccttggtcaggctggtctcgaattcctgacctcaggtgatccacccgccttggcctcccaaagtgctgggattacaagtgtgagccaccacgcccagcctagacctagcattttaagtatcctgaggcttgttaaagatgtctatgtcacagtccagttgtagtttaagagaaacttttctgtatcaataaagggcaaatttagattaaaaaagtcagggaataaacagtatcaaaggcctctcctccccccagaaacatgcttctatagtattcttcagtttgctgatctactcaatattaatgctttcttcagctgttaagttttgattcattgcaggctaataaaggaaagtggaatttttcagggcgtggtgaattattttacctctactacacttcctaaggcccctccactcagctttgatcttatggttcattccttgtcattttcattgggttgaagggacctccaaagggaacattggtttaatcactgcttccttcctaatgtagctctgattgctaaactgtctggggttcttttgaaatccttatattacagctctcttgggctttcctctgcaatcacccttcacacagtctttattggaggggttacaaaatgatatatgtcactcagtctctctaggccctttttctaaaattagtaaaatgcacagtccttgtatctttggaccctcaagcctttattttaattctatgtgtttattaattgtggtccctacccctcagaatcagagcacatatacaaatccttgaccttgaaagttttatggccccagagaaacaaagattaatcataattgttatcttcctgaaaatctcaagccctgcttccctttttaagtgcacagatgattcctgaaccaacaggaaacaaagttgagaaatttttgagcgtttcttttctttgccattgtccagaaagagaatatagttctcccaagactgtccaattcattttcatattgttaaagtaacaaatgtccttcttgattctaatctcatctcgttcttggcaaataagatttcactgtcttaacttccctgcacataataattcactcctttccttgcgctccagccaaactccaggtggttttgctatcacatttaaaacactgtctaagttactgcatagtgtgagcctcttctccataccaaactctgatctccagctcaggaagcatgtcttattcatcactgtatgtccagagcatagcaaatagcatgcacatagttactgcttaataaatgcatatacaatgaatgaataatgaatagcagtcatgtagaagtcagtagtgggttttccgttagcataagatcaagaattttgtccattatatggcacaatagccctgctgctttcatactgaaagttgtgcttcatttcaactactctgtgtgtgtttgtgtgtgtgtgtgtgtgtgtgtgtgtgtgtgagagagagagagagagagagagagagagagacaaagactctgaaacagctgctaaagagagcaaaccgggatgaatgtataacctattattagcagatagcattttgataccccactcctagttcaatcctagtttatttcttttttgcctcatttctctcatttttaatttttttatgttgagcaactttataagcaacttaaaaccttttttaggcacatcagttaatcttttgtgttttgtagaaataataaagaagcataaaaaagatctagtccctctttgctgaagaggaaagtatggggcaaaaaatcatgaggatgctatttactgctgcctggatattgaagtaacatgttaggagcctgtcttagtccatttgggatactataacaaaataccatagaccaggtagcatgtaaataatagacacttatttctcttggttctggaggctgggaagttcaatatcaaggcactggcagaaggatcccatgttggtttatagacagccatctttttgctataacctcccttgtcaggaaggcaagggcctgtcttgggcttcttttataagagttctaatcccattcataagggctctgctctcatgacctaatcactcccccaaagcccttcctcctaataccatcacgttgggggttaggatttcaacatgtaaattttgggaagatacaaacattcaaaccactgcagaacctttaatagaactgcctcatcttcaaagtcacaatagaggaggccactgagattgagtgtgcttccccacctatcaaaacagcaaccataaagaacacatccctgagtaggtaagtaatctacatcccaacatgaaggcttaattaccatttcccctttctgtgattttacacgtaggatttactgtagacagttttgagttaccttgacagaaccgaataaacatttaaacacatattataaaaaggttgtaagtttttcttgctttcaaatgactgagcaccaacccagagccttcacatttaactcactgctataagtgctctaaaggaaatgtttgctcttctgagaaatggtattagacactggattagaggtgatgacaactttgtggattaagacctctgataagcttgctgttgcaaatatatatatatatatatattaaccaaacatttgaatagcatgtaaaatgaaatatgaatacagttaagtgtcatatatgatttctatacatgagtagacattacagtgttacagcaaagaaattaaaccaatttgcatactaaagttaatgataataatggctgtcctttactgactccttatcacatgctaggtatatgctaagcactttgattacctcatttatccctcacaacaaatttatgggggaaaaaatagattttatttatattttacaaataaggctaatgaggctcagacaggtaatttctttcacccatagtcacaaagctattaaaaagcagtgctggtgctcaaagccagggctatctgattcagagttcacatcggtaagctcttcactttctcactgttttgtgaaattatcatgttcttttcttcacttcagaatgacccagacagtggtgagttttggtgtatttccacacataatccaacccagtgagattagtctctgttctatgtgacaacaggcaacagaatctttaagcaagtctttaatttagaggttggtgcaaaagtatgaattttaaatcattttataactaaacacatctttattaatcaaaatagaatccattacaatgaacacatttttgccaacaagaaataagtttgtttattcctgtagtgtaaaaatctgtgcttctggatttgatgaactgttggaaagcattttctgcatcctgctggttgtggaagcattttccctgcaaaaagttgtcgagatgcttgaagaaatggtagtcggttggcgagaggttaggcgaatatggcagatgaggcaaaacttcagagcccaattcattcaacttttgaagcgttggttgtgcgacgtgtggttgggcattgttgtagagaagaattgggccctttctgttgcccaatgccagctgcagcgttgcagttttcagtgcatctcatcgatttgctgagcatacttctcagaggtaatggtttcgccaggattcagaaagctgtagtggatcagaccagcagcaaaccaccaaacagtgaccatgaccttttttttggtggaagtttggctttgggaagtgctttggagctcggtccaaccactgagctggtcatcgccagttgtcctataaaatccacttttcatcgcgcatcacaatccgattgagaaatggttcattgttgttgcatagaatacgagaagatgacacttcaaaacgacaattttttttttgaattttctttcagtcagctcatgaggcacccacttatccagctttttcacctttccaatttgcttcaaatgcccaatgacagtagaatggtcgtcattgggttctttggcaacgtcttgtgttgttgtaagaggatcagctttgatgattgctctcacttggtcattgtcaacttccgatggctgcccactaggcttcttatcttcaaggctgtcgtctcctttgcaaaacttcttgaaccaccgctgctctgtacatatgttagccactcctgggccaaaatgcattattgatgttgcaagttgtctccactgctttatgagatattttgaactagaataagaaaatcgctcgaatttactttttgtctaacataatctccatagtctaaaataaacataaaacaaacagcaagtaataagtcattagcaaaaaaaccataaatcgagaaatgcccactaaaatgatgtataatataaccacatttatttaagaatgtattccattatcaaatggcaaattccaacaatggaaattccttttgtaccaacctaatattttctcctgactcctctccacacacctaggtaataggccaactatatgagtaaggaagagcagccctgacctttacgaaaattgtgttgtttaaaagcacatgataccttcccaaatgggatggatatcacacttttgaattttcagtgtgtttttaaattatttccattttgtagcacatgcaagatttatttgaagaaagaaaaaaaataaagaaaagaacaaataaactattgtaccatcataaagggaagtgtttgaagatattagctggcccagctccacaattaagaagtttggctacaattaaaaacttaagaatatcagtcaaaaatatttactgtctattagatcatcatttttttaatgagaagaaatttagaaagtgcataaggagacagccttacattgtttaaagccagttttagactatttggacttttcttatacatgcatgagtatgctcagaaattcaaattactctgctgttcctattttatttcactgccctgaaatcctgttgttgaaactacaagacttgaaaataacaggaacatcctgttgacaaaaataaattccttatgataaaatatttttcaactgaagccaattttttttggatggggaaagggccttggtgggagaggggattgtgagtgacagaatgttggtttgggttcattgctctttcctcctagctttgctctctctccttctaacggaattagttgtattattttacatgaatttttgtattatgcaaaaatgttgatgtgtggtgtctttgaaaactgttttatggaaggaatacgtgtgtctgtgctgcccaggtattactagtgagtattatacttaggaatgagcatgtttagtgtgatgttcactaaacacttgatttattcaatagtcccctaacccctgggaatgcatatgcaaagaataaaatgtttcagacatttgcttaacaagggattttagattatttgcagaatatggtccctgaaaacattttaggttatttttccatggagtctgacttacgctgagaagcctcattatagcactgaccaggagtttaaacagtcaggtgctgggcaggcctcagaagtccttgcacttggtttcttcacccatcatgctggagggagggtggcatgacctctactatcccttctagtgctcagattcaatgaaggaacttattttttaaagaaggaagtgctgttatctttctaatgggcagctcagaatggcagggatattaatagtggcctgcattccaatagtcaacactgagatcttccagcagtcaccccatccagaatgcaggctttgaaaggctagaaaccctccctcttccataaaatcgttaggtaattgacctttttttttttttggcatcttttgccctctttttggaagctttgtgggagtgggacagtagtatggaagataagaaaccctaagtttaaatccctagaaaagcccctgaaccaatagtcaatttactgctgctaacaccactggccagactggtttgtcagtcactggtggtgtgatggtgtcatgttgggcttccttattacgtgcctctttttgaatgacccatcattaccttgacttttcaaattggaccaagtttcaacactgattttgcagaaacacacatgagtcatgaggaaaagtagcaaagggaaagttttcctccttcccctcatgcggacgtgctgtggacacaggcagacaatcataattgcatgactgagtcaccttacacacctgctgatcggtaaagaactcaagagagaaagagctgatttcacctgcctcttccacaaagtctcctgactaccccaactgaggcactgttttctttcactgaactcatactgcacagcacttttctctgacacataaataaatgtgatgaatgttcacactttcctctctactatttggtatcttctcttttttaatgcaaattaaatcttgtatactgtatacataggaggatttgggcttagcaatagacgacagtgatcatggttatcttttattgagtacctacggcatgccagcctctgatccaagacctttacatgtattcactcatttggttctcactgcactcttgtaaggtagatgccattgttttccctattttattttttggaaaactgagctgtggagaagctacatactgagtatgtggagaagctacatagttgcaaagtcaataagaggtgtacctgggatccttccaaatatctggcctcagagccttcattattaccagtattttttttgcaagcagaattattctaacccatcagtaaaaggcttctcctcactctgtccttccccctacattataccctcaacagcaagatcattttcttttgagaagcttctttacaaaaatcataaaggagctctcttgacatctgtctatctagctcattagacgtgtctagtttagggcagttcaaattgggacttttaaaatgttgcctctacatatgtatgatctaattcttaccacttcaaagcttcagggaaagtgaaatgtgtcatttccccctcaatattgggaattccccataaagtggataaaattttagcctgtatttccttttagttttactttcctcttctgaaattaattcatgacctctatctcaagttttctccagatttttggcccatatttctttttaacatttatcaaatatcccttgcatattggccttttacatttcttaagtttccagttttaactgtaacattgcaggacacataaaaatgataaataaatactaattaatagtaacatcatagactagcaacaatccaatatgagcatatttagggtttagatatcttagtacatttttatgtactaacccattacacagcaaacaccaacgtccttacatatttattcaattaaaaaattaggataccaggattgaaatgggctctgcaacagagctgagtattggatttgagacataagtcatctacaacttaagataataaccttaaaatgatggacatataacctcatctactcacactgtcactgttttcttgctgtttgtttgtttgttgctggggggcggggcagcagttttggttcttttgcttgtttgtttgtttggttttttgagacactctgttgcccaggctggagtgcagtggcatgattatggctccagccatcctcccacctcagcctcccaagtagctggaactacaggcacactccaccatgcctggcaattttatatgtgtgtgtgtatatatatatatatatatatttttttttttaatagagacgaggtttcaccatgttgtcaaggctggtttcaaactcctagcctcaagaaatcccccaacctcagcctcccgaagtgctgaggttacaagcatgagccaccacaccaagccactgttttcttaataattgaaagttaccttactatttccagaatttcatgattaaaattttaataatagtgcaaagaaatgtatagtgtattttaaacagagtatgactaactttaaccgatgatttcttaatggttttaagttatttaggatcaccagttattgcaatgtgctgcaaatgttaatgtgactaaagatggcaaatatgggtgtgactgaatgttcacccctgcaggggatgctctagaagttttttcttggagcatttgtaactatcacataaagccacatatggggctaatttccaggtcagtgtaatgtggctactgttctctaaaatgtgatgaataattaaacgtttaattatccttctacaaaatgatttttgcccttttgaggaatcaaaccattgctgtgaggatttttttgccagtcagacatctacaacatgaatagtggccaagagtgacactcattgggcatagacccatccagaatgcaggctctgaaaggctagaaactctcccttttctagaaaatcattaggtaaccagccttttctttccaggcaccttttgccctctttttggagcaagaggtaagaacaggacaccttgaatactctaggacaacgatattttccagtaccaaacaattttgttttatgagagaacatagagcattcatacatacaaaaaataacaagtcagcctgaccttattctgatgaaatgctgatggggcttgattcactggaacctacctggaatgaagttggcaagcggtgtccagtggatttatttcagcagttttatcaagttgcttagggaacaggctgctcagacttgagtttcttggaaaaagactttaacctactaatagttggagtccattatttgcctttggaattatatgtaaatatatttaactccttaatgagccagggatgtgggcaattcttccttattaaccaagagctaattatttacaatataaggtggtattttaatgtagccagtatatctgactacttcaaaatcttagtttaatatcaaatgaaatcaaatacctgctcttttcgaattagatgaaataatattgctgtaatgtgtccatttttctttcctcaatcttttcaagcaatataagcatataagtacattttaagcacttaaaaatgagcccaattcttgttccttggtcctttggcattttttgagggatttgtcaatatgtagagttagttagcaattctcaccatggtgtggagtgtgctctaaaacaggtagacatgatagtgatcctgtgcatcttcaagagcaatgttgtttaaagaatagttgtgtgttcactccctttttctctctatcacttgctcactagctatgttttaactatggtcattgtagttgcaggtaaatccacaagagttatttcaagttgaaggggggtgggagtatagcagtataccacaggcattcccgtggatattcaaaagtggtacagttggacctcaggaaacctagaactagcatgctagaaaccagagccacattgttcttcttttagagaccacagagtctctcatttgtgtgttgttacttgcatctgaaccctcttcttcttctctccccttttctcttgcttcctcttcccctttctctgttcatttattctgaagatttgtttgtttgctccaatatggccatttgccctgacatcaactctagtgtccaccaataatgtgcaactgtccctgtcaaattctcaagggcaaaagacagattggctcagctcagcttttagagcagagtcaccaaattataagtcaggggcaagcaagaatcgttgtctctgaggcaggtgctcatctcagaactagtcatctgtggctgggagagtgggggtggaggatgtagcacaggggtccccctttccagaaactttgagtagcacaggtcactgtggaatatgtctgttgcactcacacagaaaccttattccttcaacagctgtttagatgcagcagaactgaatattaacgtcgtagcacacccactgcaccccagcactttccttcccatctcgtttggccagtctgcagatctgcggtatcctctgtcactttactgctagctctccttttctgcaacattcagattgcttctgaacattgcatctgaacagcccaggcttctaaatatcacagatctctgtttttctatcccttttgctttcagctgtttttctttcttgctggttcttcaggctgttgtgaccaccatgtgctgtgaaatctctgtctgattctttttggagttccatagccccttggctccctaccaaagagatgtaaagattaactagttaattaggttaagctactttatgtctaaagagtgtgctagaagagtgtttctcaaactttttttttttttttttttttttgaggcagagtttcactctgttacccaggctggagtgcagtggcacgatcttggctcactgcaacctccacctcctgggctcaagcgatcctcccacttcaccctccgagaaactgggaacacaggcatggtgccaccacacctggctaatttttgtattttttgtagagatggagtttctccatgttgctcaggctggtcttgaactcctgagctcaagcgatctgcccacctcggcctcccaaagtgctgagattataggcatgagccactgcaccaactgtttttctcaaactttaaacccttttcctgtttgctccaagaatgcctggcagcggtgctcgtggctacagtgtttaccccaagataacttcgccacaaaatatctcgcttttattattttcatatctgtctagtatatggattttggaaacaaaagacataattctattcatagcattctatttttagtagtggtattttcatttacaatatatagtaattccctatcgtttaaattgtcaaatcctagaacatgaagcattcctacgcatgatgttaacatcattttggaacagttggcggaagattcatttgatgaatcagatttttccaaaatagaagattctgatgattcagatgattctgatgttagttctgtttagaaataactccaagaacagtttttatgttttcatttcacattgaaaatcagtcaaatttgcttcagcctcaaagaacatgtttatgtaaaattaaatgaggctggcagtgaggtgcactttgttttctaaacaggattaatacacataggaaacacctgggaaacttgtgaaactgcagatgagattcaggagctccataggggagctggtggtggtggtggtggtggtggtggtgatggtggtgatgctgatggaagaacaacacaaattccagtagaagactagattcagaagtgctgtgcatttattgtaaatatattctacctgataggagtgaccatgccttaggcatctttatatgcccttccatgcccagcactgtagctggtatgtgattgatatttaaatgttgattggattatgattgagctgaggacacttgaaatacaggattttctatgccatatttttaagtgagaggttttcaaaaactgctaagaaccagttaaatcaataagcatttcttaaggatctgattgtgcaaagccctgggagaaatgtaaagaaaatgttacagtccctgtcctcaaaagaacactggcatatttaccactaacttgaatatgtctatactggaattgtggaaataattgtcaaattgtagaggtacagtgaaggccagtgagcctgtttatagtcctagcaatttgacgttttataatttaggtgttattttccccatatatacataacaataatgggttctagttatgtttcagtgggataatgcatgtgaggattgggtttcataccctgcacacagtaaatgattgctagcagtagtagtagtggtagtagtaatacttaattagtcttaattatccagccagtccagtttaggaaaaactgttcccctctccctctctttgctttcttaatgttccatttcactttgtagagattatctgtagtttaatcttgatgttgttcaaagtataaacttaaacaaaaatgcattttagaatgtagttgattcccctggatatgaaaattgctgtatgctctacaacagaaagacaggaagaggaatatattttcctaccttacaactgtttaaacccaagctgtatttctccttttctctgatgttttcataaatttattcctttaaaaaaattaatgtgcttaaagtgtttctctaagtctttccagccattttggattgaccaggaaatacgtacacacacaatgcatgcatgcataaattcacaggcgaataaaaatgtatgttaaataagagcgttatctttggaaagaatgtaaattgagtatacaaggaaaggaatattgaaatcataaatagtgtcttagactttataaaggataagcatctacagaattaataacatctgtattcttcaactaataaaaccaataagcagatatactgtactctctatacaaattagaaaccagtttgtgataaatggtgaacaattcttgattgctagatcatcccatgtactccccatataaagtaggtcatcactatgaatttccatgtagagaagaaaaagttgaagtgacaaatgtatcttttaatgtagaggctatcattgaagaaatactcaggagacctctgagggaggctggcacatgagcctgtgaatcatgactattatccttgtcttagaagtactcacaaagaagaccttggaaacatttattgtcctttcactacctgggtccttttcattacctatgtaacccagatgtaacctggctgtccagctgcctggattccttcagattttccagtttgccagggtcaacttgttctttaaaatataatgtaaatggactcaaatcacaatctcatgcacagggagttcccagcatccattccagtatttttagtggttgtaagcggagttcatgtctctcctggacccctctgcctctgagttccttcttacgaatatttcagacaggaataaagaagttgaaatactccatgccgcccacataaaatttttttaaatcaaattgggtaacgcaagtgaaaacatttcagtaagtataaagcattaccgaggagagataataatcttactaaattagaaagtgagttaaagcattgggaatgctccgagggtagactcagaggaggaaaaactgaaggtaatgaaacagcatctacttgtttcatctggcgaaatatagggaaaaggatgaagtcctgacaagactttgaagtgaattagaattgtctgtaggttctaataagaaaatctatccatgaaagtttaaaaaggaacagtaaaagttatgtggttgtaagaccccaaaagactattcaacacccgaagagagagagattcctgaagttctttgaagctggttgagctgcaattacagagaacacattctcctcacctttttaaggaagcaaatccacatggccgttgtctcattttctcttctcatatctgccagatgtgttcttgaagcaatagctgcacgttaatcagctacttccacagccctggtgcgggcattgccttctttctgcttatttcttatgttacattcagtttttccaagaattcattcccagccttatttcaaaagctactctaacatgatattcacagtttcctaacacccctgatcactttatgtgctctaatcctcaaactaactacctgaatatactgtacctctaatttgggtggactggaggaaattctggttggcgaggctactttttttttctctcaagggtagaatatagttcatttatcttgaacatttttaagtatttgggagaaattttattatacagcagtagaaattttattcagacagtattgctcagaaaataatacctatcagctttaaaagaagagttaaaaggtaatttaaaacaagaaggtgttaagtatatgagacataatttggggatgtggaatcatagctggtcccagctcctctccatggaccatcagggagtggcagcccatttgttatctgcaccatgggttaccctgatatccctgcctcctttgcaaatgttaagtgtttcacaacagtgtctgactccctgaaccctaagaggtagtacacaaggcaggcagtttttgtttgaaggagattgggatggagtcctggctggacagcagtgagcaaggggatgggccctgcagttctgcaatgctgtagatagagaagaaggcaagaggagctgccaacgagaacaggcatgctgtgggagcaagccctcctccttaacattctggcccaacattgaccaagtggaggatgaacatggagtaggtactctcaggggcctattacttctgagaagtcatgacttgtggagctctgaataaaaggagaaaaggggatggcttcaggattgggtcattttcctgccccttttctgaaaggatgagccatcaatgtcaagtcatcctataagtagggagaattgcaaaggagatttttttttttttttttttgagacggagtctcgctcttgttgcccaggctggagtgcaatggcgtgatctcagctcaccacaacctctgcctctgggttcgtgtgattctcctgccttagccttccgagtagctgggattaaaagcatgtgccaccacacccagctaattttgtatttttagtagagaaggggtttctccatgttgttcaggctggtcttgaactcccgacctcaggtgatctgcccacctcagcctcccaaagtgctgggattacaggcgtgagccaccgcgcctggccgcaaaggagatttttaagatcattagcgcttagagagttcccttctcttcctgagtggagcagtggatatgtctggttacttccaacctcccaaaggttcacattgcttgtttaattttttagtcaaaatgatgtgtcatcagctggaggtcacctttcaaagtctgctcttatagcactctgtacaaaatctttatattcctagagtaattcaataattgagtcagtaattttccctattttgctgtcccaaattgaattgtgatgacatttttcaagacacaaataaggcagtgaaacctacctgtgtttcttcatcagtatctgaatttgtaaaagcatctttaggctacttgctgtcaatggaattcataattcacatgaaaaaaataagtgaccatttgaagccaatatgcataagaatgagtaaccagcatgaccactgtttttagtgcaggagtgtgttcaatattaagaccattaatgtttgcccattttatttaatcatgtgcccttcatgtggaagaatcaggtcttattgcatacagatgagtgttcaggtaatgattcaggcttcatgctatcaaaattaaattctaaaagccaagaaatttatcatttttatatccctttgcagatacagagtatgtgtagaaatatctcttgaaatatgccttgtttacgtgagaaataaaataagcagattatgttaattagaaatagtatctgagtggccaggtgcagtggctcacgcctataaacccagcactttgggaggccagggcaggtggatcacaagatcaggagatcaagaccatcctggctaacatggtgaaaccccatctctacttaaaaaaaaaaacaaaaaacaaaaaaattagctgggcatggtggtgggcatctgtagtcccagctactcaggaggctgaggcaggagaatggtgtgaacccaggaggcggaacttgcagtgagccgagatcgcaccactgcacttgagcctggatgacagagcgggactccatctcaaaaaaaaaaaagaactagtatctgagttaggcctttaataatatatttctttttaatataaaattgaggcactcacaaaaaaaaaatacctaagaatacctctggccaaggacaagaaacatctctacaaggagaactacaaaacactgctgaaagaaataatacatgacacaaacaattggaaaagcattccagctagtggattagaggaatcaatattgttcaaatggccatactacccaaagcaatctacagagtcaatgctattcctatcaaactaccaacatcatttttcatagaattagaaaaaagctattctaaaattcatatgaaacaaaaaaaaaaaaatagcctgaatagccaaagaaatcctaagcaaaaagaacgaagccagaggcatcacattacctggctttaaaatatactaaaaggctatagtaaccaaaacagcatggtactgatacaaaaacagacacatagaccaatagaataagttagaaaaccgaaaaaaaaggctacacacctacaaacatctgatcttctgcaaagctgacaagaacaaatgacagggaaaggactctctattcaataaatggtgctgggataactggctagccatatggaaaagattgaaattggaccgttccttacaccacatacaaaaattaactcaggatggattaaagacttaactgtataacctacaactataaaactccccaaagaaaacctaggaaataccattctggacataggccctggcacaatgtccatggagatttcataactatgaccccaaaagcaattgcaacaaaaacaaaaattgacaagtatcaacagagtaaacagacaactttcaaaatgggagaaaatattcacaaaccatacatctgacaaaggtctaatatccagaatgtatgaggaacgtatacaattgaacaagcaaaaaacaaataactccaccaaaatgtagacaaaaaacatgaacagatacttctcaaaagaagaattacaagcagccaacaaacatatgataaaatgctctacatcatcaatcatcagggaaatgcaaatcaaaaccacaatgaaacaccatttcacacctgtcagaatggtcattattaaaaagccaaaaaacaacagatattggcaaggtggtggagaaaagtgaatgcatgtgcactattggtgtgaatataaattacttcagaccctgtcaaaagcagtttggagatttctcagcgaacttagaacacagctctttgtcccagcaatcccattactggatatgtacccaaatgaaaataaatcgttctatcaaaaaagacacaagtacttatatgttcatcacagcactattcacaatagcaaagacatgaaatcaacccaggtgcccaacaatgctgggttggatagagaaaatgtggtacatataaaccatagaatacaatgtagccacaaaaaaaaaaaaaaatgaaatcatgtcctttgcgacagcatggatggaggccattattctaggcaaattaacataggaacaaaaaaccaaataccacgtgttttcacttataagtggaagctaagcattgggtactcttggacgtaaagatggcaacagtcactggaaactgatagatgggaaagggatggaggggggcaaggataacaaaactaacttggatattttgttcactatctgggtgatggggtcattcatgtcccaaaccttagcatcatgcaatatactcatgtaacaaacttgcacatggactcccagaacctaaaataaaggttgaagttattaaaaaaaagttaacacactattttcccaaatcagaagaatgagtgtttccctggttacttatattttggattccttctaaacaggctatgcgtgattccccctgagttgtcttcaaagtctagtgtttatggctgtatcataatctaggtttgtagatattatattttggaaaaatagaggaggtggggaaaatacttcaaaagaggcacttcttactattaaggtttcttgtaattgaaagtatagtcttgtaacttggaggtatatcccttataagaatacttcagaagcagttttagatattgagaacctgtttaacgttcctccatttgagattttcatgcaagattttatgtaaagcgcaagtggatgttatgttccataagtaaaaatttctagttatatctctaaaaccattttgccgataatttcagtattaccaaaataaataaataatctaagtttgccttggaccccactatcctatctaaactctggtaataataaatataattgtgcagtatagcttctaaatggaaaaattatcttcattttcaagagagaatagatggctcttggggaaatgtatagttaaggaataagaaaactgtcagtcattcaaaaaacaagattgtggagatgacaagagtggagccctgggaatcctcagatttgcctttaaacaataccatctctcttgtggtttccaaaggattctggagctggaaaagcaaggcaaactcacgctttcttattagctccctaatggtgatatgatccctcatcctttatttcctctgttaggaagaaaactcctcccaggaagaaaactccaaatggagagagagggaaggaaatagaaagggagagaagggagagggggtggaggggagagagcaggtagcttggcctcctcctatgcaggagcaacaatggtctctgtgaccttttaccctgaggggccagagaggtcaagagaggtccctgcagacatgatcagtcattgataggacacagtgactttgtcatcagccccatggccataaatcctgatggcattcttcttcttttgaggttaaatagaggaaggaaatagaaaggaacctggtactctccctggaatccaccaactaatttgaaacataagctgggcatgactagatcagtggttcccaaagtgtgttccagggcacattagtcctatagcatgaccatatgtctgtgtatctgtgtgtgcatgtgtgtgtgaaaaaggagaagggtttaattttcgttgaagtctagaaatgatgggttaaacaaaatttactaaatgctgtatgtgaattatttcggttaatcttgacaactaacttttgttgcagatgctattataatccttattttatttatttatttttattttattaatttttttttgagatggagtctccctctgtcacctgggctggagtgcagtggcatgatcttggatcattgcaacctctgcctcccggtttcaagcaattctccctcctcagcctcccaagtagctgggactacaggcacctgccaccacactcagctaatttttttgtatttttagtagagacggggcttcaccatgttggccaggctagtctcgaactcctgatctcaggggatctgcctgcctcggcctcccaaagtgctgggattacaggcatgaaccactgcaccccgcctataatccttattttaaagatgagagacagttcagagaagttaaaaagtatatctaaagtgactctttttttttaagatgtggtgctggatttaatagcctgatttcagagcccagatctcttgactccatgactttctgtggcctttttaaaatgaacagatatgtacccttaacttctatgagatgtatatagtgtgcatctctcaaatttatttggccataagcttttttgaagttttctgaactttacaagaggtgaatgttccagggaacctactgtgtgaagcagtgggctagatttaatcagatgttgtactcaaacaaaacttcagtttggcaaaccaaaaatctgatgttgccagcatctggatacaaagagctagtataaagtagtgatgtgatacattctgcatttagaaatatttgcgctgaaagtgtctgagttacttcttctcatttctcttccaggtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcaggtttgaaaggaactatatttgtactttggagatggaaacgctttaatggtgggaaaatgtcactgaattttttttatcaaaaagagggaagttcggctcatctttcagctctgaagccacaagttaagctatagctctccagtttctcctgcttcttggtacctctgatgtctccctttcttcagggctctgtaggttttattgttcattccaattttgtccttaagatattgatatccaagtaaatgagtcgcagccttgggagccacttcccaagctttcattaagtgaagcaataataacttgtgttctacctgtgaaatctgttcatttctctccgattctgagacttctgcacagtttaacaaacctccgcagtgctcatgagtgtgcatgcagagctctggttgtgctgacagatgtttaaaaacatgtaatcagacagctacatgagtggctacacatgtctggttacttaagagtgcaagcctttctagttcaaattggctttcactacagctcattttttccctttgaatcatacctaacagaggtttttatgatctgattctttttattattgtttttagactagagtccctcaggaattttcttaactagaagcaatagccacacacctacatacagaaaatgctctgtaaaatgttatgtgagtgactgggatattagggagcagcttaagagctgggagtagaggatccctcttgggccaatgaggaacagaagtcttcttttttctaaagttttacaagtctaaagccaaatgaatgacagtcttagaggaattcctcacgttttaagtgcttgtcaaagtttaagcaagtagcatatataaggtctctagaatagtgtctaatacatttttaggggctcagtagctacagggcgtcactctaatgtaatgcagttctagttcctgaacttgatcagttaatatgcaaaaggattttccttgtagtataaagaaaagacactcgtttgtattactttgtgggatagtttgtagcatagcagtatctagccatctcttttctaattctttctcatttagcatgcaatcattgtgttggcagaattttcttttttttctgagacagggtcttactctgtcacccagcttggagtgcagtggcatgatcttggctcacggcagcctctgcctataagattcaagcaattctccttcctcagcctcttgagtagctgggactacattcatgtgccaccatgcctggccaacttttgtattttcagtggagatggggtttcaccacattgcccaggctggtcttgaactcctgagctcaggcgatccacctgcttcagcctcccaaagtgctaggatgacaggcgtgagccaccacgcccagccgaggaatattgtttaaggttaattaattaatcttaactcctttaataaaaaatattcaatgtataaattctactttttcacgggacacagaagttatctagaagctatgcttgttttttcagttttaatactctttattttttaaattactttttaaaaatgtaacttctttctttttacatttattttaggttgagaggtatatgtgcatgtttattatgtagataaattgcatgtcacctcatgggggtttggtgtacagattatttcaccacccaggtaataagcacagtatccaataggtagtttttaagtcctcaccctcctctttccctctaccctcaagtaggccccagtgtctcttattcccgtctttgtgtctatatgtactcaatatttactcccacttattagtgagaacatgtggtatttggttttctcttcctctgttagttcacttaggataacagcctccagctccatctgtgttgctgcaaaggagatgatctcggttttttatgactgcataatattccatggtgtatatgtaccacattttctttatccagtctaccactgatgggtatttaggttgatttcatgtctttgctattgtgaatagtgctgtgattaacatatgtgtgcatgtgtcttcatggtagaacaatttctattcctttgggtacatacccagcaatgggattcctgagtcaagtagtaattctgctttgagttctttgagagacagccaaactgcatttcacaatggctgaactaatttacattcctaccagtagtgtataagcaagcattcccttttcgctacagccttgccagcatctgttattttttaactttttaatgatagccattctgactggtgtgaagtggtatctcattgtggttttgatttgcatttctctaatgattagcaatgttgggcattttcatatgcttgttggcttcttcatggcacatatgtcttcttttgaaaagtatctgttcatgtattttgcccactttttaatgggcttgtttggtttttgcctgttcatttgtttaggttcctcataggttctggatattagaccattgtgagcgcatagtttgcaaaaattttctcccattctgtaggttgcctttttactgtgttgataatttcttttgctgtgcaggagctctttagtttaattaggtcccatttcagaagctatgcttttaatcaacttgggattcatcttattaaaatgtacattcttttggggggagaatggtggtttgttttttcctctaagtgacaagatttattgttttatatataatgtaaaagtgccaatgtttgcatgttttcaataatgctaacataggggcctaacatagtgacttaattctttgaatgcctaaatcacccctgcacctcttgaatatgcttcattactgatatagtagataaaacagtaccctgattatcagaaaaagatagccctcaagcattgaatataaggcaaaagttccagcacagttgtatcttaatgagggaaccctctcttgcaataaaatgtgaatagaagcattgccctattgttgtgttacaaatttaaaaagtgtgatatttctaattcccctattcccatggcaatttattctaatagtcattatacttggacttccacagcagttttctgattggtatctctggttctactctttttcttctccatttcattatctcagatgtctacattttaaaaatataaagtggattttctcattctccagcatttcagtcaaggtttctctcattgccccaaaaaaaagtccagtccctttagcttacaagagtttccacggtctgacccaggaccatctttccattcccaagttagttactattatcctgcattctgacatgccaatctatttactttttcctaaattttcctgatattgccatctttgcttatgtaaagaaatctttactttgagctcctcctcattagttggtaaaacccacgtgctcaataagtgatatgggaaaatgtagatgagtgagagacagatgcaaggggcttatcaccttcccatattctttattagctctacaaagctttccaaaataacttcagaatctaaacaacagtgatgtgcttgacaatcacaagttaattctcctggacatcactttacttctttacagaaattctagaaactttcaatattctcccccttttgtgaagccttaggaattgcctctttatggaatcacaccaaataagaattactcattcccttctttatgcctttaaagtatttgtccctttagtcattgtagcacttatcttagaatggagtggtcacttgttttggtgtgtgtggttggtggatttccttaataaattattaattccttgagggcaggaaccatttagtattcatctctgtatccccagggccttgcagagtgcttagtggatagcaggagcataattaatgtttattaattaaatgaataaattaataatcatcaatgtaccacaaaattatataactgtaaaaatggatacccaagctaaagatagcattaagaagagaaactgtaatattatcaaagtagaaattaaatgacttaattctctgatctgtttgtaaatattcctcaaaagttattattattaggactatttttataagaaatattttttaaagctttacctctataattcccaaaactacatgttcagctttgccctcaacctgatcttttgtgtttttatattcaacatactataactcacctctacttgaatatgctccacttaactcaaattcaaaatttctttttttttcttttccagataattctttttttatttttaattatactttaagttctagggtacatgtgcacaacgtgcaggtttgttacataggtatatgtgtgccatgttggtttgctgcacccatcaactcatcatttacattaggtatttcttctatttactctaccacggagcacttgacactctctttgaaactttttgctaaaattctcttgtgctgacttgtaaaatatccagttaaggtggtactgtaaattcacgttttgccttctgccttactgtatatacagaatagccaaagaataacgtataacaaaagaatgttaaaaataccgtgggcatctctatagaacagaaatcaagcagaaacaccaaatgtactggtagactaggccaaaaccatagacctgatatctcctggggtccagaagcaggtagatgcaggacattttgttaggctcaaaatcttccatgatttctgtagaactgagctccaagctaatcactctttttgtggattaaatgtgcctgacaacagaagcaactttgcatcacatttgttcactggttataatgaatacaagtaaccatcccttacaccgtgtattttgagtgacttttttgttctcaacatcccttaatttcaaacagagttcaaataaactcagtgaaacccaaaggaatggggagaacaaagaataagcacctcataaatggaatacactcagtgctatagatgcccactgtcaaccccttccctccctgagcatggcctgggacaggacaactcggctttttgtggccctttgactgccatgaaccaaattgttgaaggtcagtggctcctaatgagaatcacttgcctcctcttcccttcagtgggtggatgtgcagtgagaatgagttatgataaaggtatgtacctgaactaaatttcaatatctcaagcagcattttaaacaaagcctgtaattttcgggcttggttttgatctctggcaacgataagcatgtctctctttttaggctcattagaatttactgactcctttctgattcatgatccagttcttatatgaggaatgattcatggatcaggagaggaaaattcatttcaatcaagaaagaaagtagatgattacaaatccccttcttctaaaaatcccacacataggtttcaatatgatatatgaaaatggaaatgtggctggatccagctagtcatgtaatgtgaacctgaggtatttagaatctcctggtactgtaatggccacatctcttacatgggagcattatttgaggatgaatgcttccatttcttcaaccttagagtgaacaacaatagtaatataaatcaatattttattattattataaaaattattgaaaactttttatagtgaatattgtaaatgctcatcccttacatcctaaagttgagtgccttttttactcttgtcgtttttaaaatttcaaatagagcaaaggaaatgaaatccaaaggaaaaagagggaaaggaaagagctcctggtaaataaaataaactgtgtttcagtctccaaagatggctgccatcagttacttttctccttttatgtaggtgctactcctcacatcaaaggatggagactagttctcatccttttacatctggactgtctttggacttgcttagaccaatgtaatgtgatggaagtgatgctttttcataatgggcctagactttaagatgaatggcagttttagattccttcctcttggaagccaccatctaagttcaattacccagagaccaccacggtggtagaaaccccacgctggccatgtgcagcagacatgtgcaaaggcaggctcagccagcctccagttgtgtcaggcaaaccagctctgattccagacatggacatgtgagtgaagaaggcttcttgtaggttccatccccaatggacaccacacagagttgaaaacctgcctagcccagattgcagaattgggagaaatagtacattattttaagtcactaagtttggtgctagcttatttgaagcagtcagtagctgaaacattctggtgtttcaatatcctcattattctcacatcaaacttgtaagtatgtcattgtccttttaaatgttactgcttgcagaaaccttcaggatttataaataaaaatgggaaaacatgatatgattttttttcctaaagcagaattggggcttctgctaaagtaaagtaaaagtgatcttacccagtaacagtatgtacttgaataggatccagaatgaccaacattacaggtttcacatgtccttggcagttagatgcctgtttgcagtctactccaagctccatttctgaaaataacattttaaaaaaacaatgccttggggcctaaggaaaaccccagcttctcactcaaccgtgaacagacactcccactcaagcttgaaaaaatctttgtgaagcacagttcactcttcccacattttgccaatagtggtgggggaaatcccacatgttaaaaacacatacatatggatgcccattctctgcttaggtttttgatctcaatcctcgaagattcatatcagaaatctctctgcctggaagatgatgtgtagtcattcagtgtttgttttcttcattattgtttctgaaaacacttaggatttgatactgctcatgaaaaactcctagaacaataacatcaggagttgcctaaggctttgcacatcatcatgaaaagtaaaaaggaaaatcatatttttgagagaaggtttaaatttctgttgaaacacccctgatttacaatgtagccaagaaggaaaaggggctgaccacttgtggcagaccgggcctttctagaactcaggtttcctggatttcttactttagtgagctgccttttaccagtctcaattggagatggatgaggacaaaggtaatccccaactctggctatttcagtactaaactattatgtttaattgacatcttttttctaggtggacagagggcatagagcatggatatgggacgggggtgagagaaagagtaaagggctggcactgcatgtaagtgcaggtgtgcatctccctttgcaccttggtggtccacatcatggttattgtcatcatcactgccacccattacgattcaccattcatcaggcactgtgttaagaatttcacgtatgttatctcagtttaatatatatatatatgtacataatatctgtacatatttatggggtacatgtgacattttgtaacatacatagaatgtgtaatgatcatgtcagggtatttgggatgtccatcaccttgaatatttatcatttcaatgtgctggggtcatttcaagttatctcttctagctattttgaaatatacaatacatgttgttaactatagtcaactagtttgctatcaaacattttatctcaatttttacatgaagcctattaagcaggtatgatttcctctagtcagacaaggaaatcaaggaaatgagaggcttagaaacgttttcacatttacagggctgctcagttgtgggattagaatcagaggttgattcacaagctctccagagctgccattgttgttcacatcaatacttctgcccttaccattttgttttcaaaactcttcttggtaatagtgacatgtaaacattaaattttaaacttagagaactctaatttcataaaagtagtattagactttacacccagctccgcacaccctgcaaaaaaaaaaaaaaaaaaaaaaacttgaagtgatcagggttggaaaattactccttcatcttctacttaatcttctgatttccaagaaagattgcccctctttatggtaccaaaacatccctagttttcctcactattctcatatgtaatgcaggtgtaataacactatttaatttcgtacagttgtgtgaaagataaaattttaattcatataagtatttagtatagttcctgaaacatactaagtcctcaatatgtgttagtatttttattagtataagaaccctttcaatatgtaattggtacagaatgcagtcagatatgtaactcctttcttctctacacttcatcaatatctctcaaatgttcccctccctttcttcatgattttgcctggtgtattagctcaggctgccatacaaaataccatagactgggtgtcctaaacaacagacatttatttgtcacagttccagagactggaagtccaagatcaaggcgtcagctgattcaggtcctggcgaggcttgcatggacattttgctctctcctctcatggatgagagagaaccctctcatgtctcttcttataaggacactaattccatcatgggggctccaccttcatgagattattacctcctgaaggcctcatctccaaataccattgcattgggagttagggcttcgacatacaaatttgggggatggaggaaacaattcagtccatagcaccttggtgatgtctcccatcatctcatccttagactattacagctgtcttgagaccaatattgttcaattcttgtctatccccattccacactgaagcattctaaaaagcaaaattggccatgtcataaaatcatctaatgacaatcattaggctatagaataaaaggaaaaaatcaggagctgggcatggtgactcacgcccgtaatcccagcactttgagaggccgaggcaggtgaatcatctgaggtcaggagttcgagaccagcctggccaacatagtgtgaaaccccgtctctacaaaaaatacaaaaattagccgggcatggtggcagacgcctgtaatcccagctacttgggaggctgaggcaggaaaatgtcttgaacccgggaggcagaggttgcagtgagccaagatcatgccattgtacttcagcctgagcaacaagagtgaaactctgtctcaaaagtaaataaataaataaaaatttaaaaaataaaataaatattcactacttctccacatagtctttaatgtcctaaccatacttaactagtgctgccacctaaaagtgatatgacttctgataaaacttgacttaaatagcacaactaaattcactgttgcttgctgagttcatcacttatggtgatgagagaggagacggaatagaattgaaactaatttccatcttgatacccatgataaataggcttcagtaaggtgttagtggaagatatgctaatgtgatacacacttaaagctaatatctgagggtaacaaagatgttgttgtttaggtgtgttgcacactctttaacccttaatgtggctggcatctcttattgacatgtgcatatcactgccatgccataccatgtttgacccagagaattaatgaaacattcccattgtttatcagttttgtattcaggctaagtaagtttcctatctatttccttgccattgttctccaaattaataataaattttaattttcctggcagatcctattttttttctgagacagagtcttactgtattgcccaggatggagtgccgtggcacaatcatagctccctgcagcttcaatctcctgggctcaagagatactcccactttgggctcccgagtagccaggactataaacacgtgctaccatgaccagctaatttttaaaattttttttacagagcatttttaaaagagcactttttaaaaaatggatgaccgaagtcttccattctactcttgggtaatgaaaatacagttaccgattttttaaaatgtatctctctaagatttgtattcagaaatagtatgtataaaacttgactagagagtagaaaaaatttttgaggctgttttatcttggaataagtatggcaacgaaagcactgtgtttctctctcaacctcgtctatgagccactttagttggtatcaacatggtgatactgtaacacactatggctctctctcccaggttcttacctgtatttccattcttggtttgcaactttttccatgtattatttgttgttattttcattatttaaagttacctctaatttatgattcagtgcctacatagttctttaaggaaatatatagtctacaatcctttgtatgatcatactttaattacatgaatcaactggtacattattaaagaggagatccggaaataaaggaaaatgggtttaccagtactagagaaacaggaagtagggaaaggtaatttggggaattagcaattgaatcataaatttctttaaaaatgaatggttagccatcattctcagcaaagtgtcgcaaggacagaaaaccaaacaccgcatgttctcactcatagatgggaattgaacaatgagaacacttggacacaggaagggggacatcacacactggggcctgtcatggggtaggggggatgggggagggatagcattaggagatatacctaatgtaaatgacgagttaatgggtgcagcacaccaacatggcacatgtatacatatgtaacaaacctgcatgttgtgcacatgtaccctagaacttaaagtataataataaaaagaaaaaaaattaatggttagcacaatacccatgatctaatgctgtactcaacagtttacatattataaaactcaagtgaatagaagaaagtgacgtttttacaatatgttgttttttgttttttgttttttgttttcagagaaaagtataccatattaaaggtgaagtgtgaatatcactgggccagaggcggtaacaaactttgatcctcacagaagtactctctcagttgctttagcataactgaaatagcctgcctcattaagtatcactttccttgcagtcagttgctaaagatcactcctctaataagatgtcagaaatatttttgttcttcacatattttgtacttcaaggccactatgtccctgcttaataatttcttttgctgggtacagtggcatgcacatatagtcccagctactcaggtggctgaggtgagatgatcactggagcccaggagttcaagactgtagtgcactgtgagtgtgcttgtgaatagccactgcattctggcttgggcaacatgagagaaataaatattgttttacaaaataatttttcctattttcgaatctgtgttttttgcttataccatcattttcctattcatgttactgtggttaccatttcttatgatcttctctcttcccaggccaccattttcctctccacatctctctgaagacaccatctttctgtccccttctgccggtttcttactcctacttgttcttcatcctcattgtaacctcccttccttccacccttagttgttcttgaaaaatacaatctggaacctcagattggaactgttaaggatattttcaccagcccccctgatttcctcactagcttggcttcctccttaagaaattttgccaatcacccaacctacagaataggagaaaaattttgcaatccacccatctgacaaagagctaatatccagaatctacaaagaacttaaacaaatttataagaaaaaaacaaacaaccccatcaaaaagtgggcaaaggatatgaacagacatttctcaaaagaagacatttatgtggccaacaggcacatgaaaaaatgctcatcatcactggtcattagagaaatgcaaatcaaaaccacagtgaaataccatctcacgccagttagaatggcgatcattaaaaagtcaggaaagaacaggtgctggagaggatgtggagaaataggaacgcttttacactgctggtgggagtgtaaattagttcaaccattgtggaagacagtgtggtgattcctcaaggatctaaaactagaaataccatttgacccagcgatcccattactgggtatatacccgaaggattataaatcatgctactatgaagacacatgcacacatatgtttattgaggcactattcacaatagcaaagacttggaaccaacccaaatgtccaacaatgatagactggattaagaaaatgtggcacatatacaccatggaatactatgcagacataaaaaaggatgagttcatgtcctttgtggggacatggatgaagctggaaaccatcattctcagcaaactatcacaaggacagaaaagcaaacaccacatgttctcacttataggtggaagttgaacaacgagaacacttggacacagggtggggaacatcacacaccggggcctgtcatgaaatggggggctgcaggaaggatagcattaggagaaatacctaatgtaaatgatgagttgatgggtgcagcaaaccaacatggcacatgtatacctatgtaacaaacctgcacgttgtgcacatgtaccctagaactttaagtacagttaaaaaatattatatatgtatacacacatatatatagaaaaaaggaaattttgccaatcaccaacccactctatgccacacagttctcttttgtcagccaattagtgctactctgtaacggatacttatttattataagtactcttaactaagccatctctgcttctgagacatcctttggattatttttaattgataagtcttaagcgatctttgaaacagattctactgccctgaagtctgtgttttatacattctatcctcactgtctagtcaagacatgaaaacaacatgctgttatctcacacgactttccttatgttctctgatcatttctctttgccgtctctcttctttgccatttttcgtttcatcttagatgagaaagtaagtagctcattctcaccaaagccagctctcccaattgtgcctttcatctgtttttcctactcttggaacttgtttcattgaattttccacaactgcctcacatcttaaatatttctctctcctgtaggtctttcttgtccatctagaaatatgtatcactttacactgcctagaagagcttactcgtaatgccgctgctttatcaaattactgccctgcctctcttctttctttaaccaacaactactcttgaagagtagttcatacaagttgcctgttctcatcaccttgtgttcacagttaagccttcagagtaccttgcttattctctttctttcatcactcataacgttggacaccaaatccactgaccactcttctcatctgcatatccttcaattcttctgtagaaatcagtactgataaccagccttccttgaaaagtccatctctcttggttttcacgacaccctattcttttacaagtattttcctgctaactcccaggtcatagccctttcttcttatgcctgaaaactctgaagtatatgtattttccagggattgcctttgcattttttatatcatagtgataattttcagatctatcaacttgagcctaacttctctctccaaatataagctcacattttcaaatgtcttttggatacattcacttgggtttctctctgatcgcttgtccttaagatgtacagatattgtcatcaactttgctcctctgccttatcctaattgctctgatctcagtgttattctttcactcctttcttttcttcttcctcttgatactttttctggttttcctaacctaaaagctagggtaatttctttcacttcatactcatactctcagatgagtggctgtcaaactaactgatcatcagaattgcttatgctttcagaaattatggtttgatgagtctcactatagacttactaaattagaatctctggtgatgaagtcccacaatctgtatatttttaagctctcttactcttttctgatttgagggtactactagagattctgtctctaaatttctgtgcctaccccttcattacattgcaggggccactcctatgccattcccctacctcaggccttcattactgagaccacagcaatccttccctaactggtgtccctgcctctagcattctctccaccaacctattttctttcctgtgagtttaagctatgtgaatatgccacacctcttctccgaaatttaaaatggcactccatttttctgtaaagtaattatgtattgtttaacctggccctcaatattccttcatgacctagtgctacaaacatctcgttactcaccttcatgggaacctttaacaccagccaaaaggaacaacttacagtaatttatgcatttgctttttgcctctctttatgctgctctcactgcctttgcctcaatatttgtatgttcaaatatggcccatcttcatggcccagccaaaattctttcttctttccccaaagttccctgataatcatcaataggaagaacctcttgttttccctgaatttttatgtaacttttataaatctctcttataatacttatctcctaccttttcttatagggtatatacaaatatatatgtaatatgcacaactatataatctttttgttgttgttttttgttttttgagacggagtctcactctgtcgcccaggctggagtacagtgcactcgacttgatcttggctcactgcaacctccgcctcccgagttcaagcgattctcctgcctcagcctcccaagtagctgagactgcaggcatgcaccactgtgcccggctaattttttttttttttttatggtagagatgggctttcaccatgttgaccaggctggtcttgcactcctgacctgaggtgatccacctgcctcggcctcccgaagtgaatgtatataatcattgagagcagatccagatgtaattcaacattttatctatcacattttatctaatacattttgatgctgaagaaatatatttcttgaataacaaacagcagccaaagtttatctggaactgttcgaagtgttccacttttcaaccaataaatcctcacaatccacaaaaccttatttgggaggcactaatagtatattcaatttacagatgaggaaattgagcctcagagcagttaagtaactaatacaaggtcacacagctagtgaaggccctcaagtagcctggttccagagtccatgcttttaatcattctgcctttttttgtgaataaattccacccagtcatattttttaacctcagtgcattttttaacatttaattggctgagggcttatattcaaaagagatctttttcttttaattgaatttgacagaggcaagctttaaattttatcataaatagccttcgagaaggcaaataatgtgatttacaattaggattcatcaacttcaaggaagaagtggaaatttgcttataggaaaaatttaaatgtgttgcatagttacataaagctctgttgtacaattttatagagactgtaaaacagaatacttataaattaataagtaattgaaataaacatcatttgattcttatactcattgaattatacaatctccaagacatgtgatttccttctccccatctttttcccccaatgccagagtatttgcaaataaatatttaatccatggttatattaaagctgctttgctaccatgaaaaaaaattttttttacaaacatctttcacagactttgtaactggacaaactccacccggtaaaaaaataagtgcatggaaacaaaacaagaatgtagcaagatctgcctagtttattaaacatgaaattgaatagtggaaatagctccatttgggaagcttaggaagcatagtgaccaaaaaactgtatggctgctcattcattagtcttaaactattaatgtcaaactcatagtacccagagttaaataagattctgatgcttctactcttaaaaagaaaaatggaagcatgtagttatgagcctggggcaaaaagaagctctaatatctaccatatatttgctaataatatcagacacacctgtgaaccagtttaaccattaacaatttaaactctacatttaaaaaagagaaaaaaaatcctagaattaaaatatcacaaaaattaaggtctacatgtaatattgacaagcaaatacagaaatcaaatttgatagtctatcattgggcacaaatcactttgatcactaatatacaagtattagacagcctctttctccctagagtatatacatagcattcaatccaggaattgccttttttttctgaacaccattgtttcccttttttttctctgtaagggcttagtccaatgttgctagtaagaatgagcaataagatattagttcactcccttatgcattaaaatccctgccacacctgtgggtattgtgccattgtttaaaagggtaataataataagcctttatataacacagatatcaaagagctttgtggtcagtcgttgttgtacatgcctaaaaacagctctgcgtgagttttgtatccatttgcttaattaaaaatataattatttaacaacagagagtaagtaatatacatacagctgttgggaaataccattatttctaagaccagacaatactttgataatctgatagctgttgggaaaagagatgcagttaatcacattaatagagagtcaaaggatttaactcaagtagaccttttagaacagtgatatggcaagggaagtaaaaaaaaaatcaaatcaaattttaaatttgtattacagttttgtgtgtgatggttagagaaccaaattaaagaaacaaaggcagctttgaagtatgttggcatttatccagattgagggtctatcagaaaatagttctgggaactgacatttatgataactcattcaaatattttcttgcacaattagggttatctttagggttaattttcctgagacatcatgccatatttgactcaagatttcagcattgaatttgagcctattaactcttaatgagtgctaactgatgtcttatcaaactatctgtaaaagataactggctattcatggccaaatacatagtcatctaatgtccaaaaattatgagaccatttagccagattcaaaatacagacataggcaagtttaaagatgcattgtacattttcattgtattacaaaagttaagtgtgttggaaaattgctgttagctgcctgagcatgcctgtagctgagttttgagctccttaatagctgagtaactggtaatgtagttagaaaactaggttaagccagtcttcagtcattagttggctgacttcatatttgttttagaactctaatcttctaagaacttgttttcataattccaccttatgaaacatttatgaaatgtgtagaaaattactacgacagctgtaaacccaaatgataattccctttcccatagtttcaataatttttttcttcactagaagaaaacagagcacttaaccttttccttaagaatcacagatctatttgatcccccctcagcaaaatattatctggcacttttgaagtacatggttcaaatagaattactctaataatagtttttgcgaggtctgtgtgggtatgtctcatctaacttggttattctccttagattcaaaattatatcctgcaaattgaaaattatatatagcttttgcaaggcaagaccataattctaggcttgtaccatttttttttcaaccccaataaatcacattcaaagtagacctgacactggactgtcttttagcatccaggagagccctaagtcagctcttgacaaagtactgcgttttaagttcccagaaaaccttgagactccactgagaatttgctcacattctcctctttaaccctggaaaatatactctaggccaatactgattcacttctctgcctgcagatctagtgtgtcacctgcacagatctttccaaatcatgcttgtatccttcacatatcagtaagggtcagggtaaatccatgtcagaaggtagtcggtggaagcctccactgtggttatgtttactgttcctacctttacctctaaagtacaagctgcttaaattaccttctaaagcaaaaatttaaaaattgtgggtcacacagtgcattgatgagtcccactgccaacctattttacatggaataggatggcatgggagagagtagagtggatgggataggataggataggataggaatcaaagtgtgtcatacattaacttgggtttcataaaagttttctttcaagattgtgtagttcacatgtaaaatgcatttctcaccgtggtttgtggtcagagtttgaaagtcagtattatacagtaaatttgacttctcaatggccctggaattgacatatgtctatggaaatcttagataaggtggattgtttctgggaagcattcaatgcttgcagcacactttttctccctccctctctttttccctcccattaaaaaacaatcccattgaagtgtctctatgggaatgttactcataggcagctttgtttacaagccacaaactcaaattttttatcaagctcctgcagcccaaaagcaattctctccctgctgtgacatccacatttctctgtgcaccttccctactctttaaagagtgaaggagatagtggggttacaatttcttgtcaattttacttttaactgtagcatgtcttgtcaattttacttttaactgtagcatgtcttcttagccagtcccataggcctttttttaattcattaaactagaatcagaaactgtcttttttaattcattaaactagtgcttgagaattatctcaatgcttctgtgagctcacattctaggagagtattaaacaataaacaactatgtaaattgtgttaggattctccatagaaacagaaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaaggtgaagctagccttcctccacctttttggttctattgaggcccttaaggtgttgggtcatgcccacttacatcagggagggccatctgcttacccagtctgcgaattaaaatgcaaatctcttttggaaacactctcacagacacactcagaaataatgtctaatcagatatctgggcttcctttaacccagtcaagttgacccataaaagtaaccatcacataaatcatatagtaagttagatgtcagtaagtgctatgaagaaactgagttagaaaagagagagtggcagggaaaatagaagatgctgagatgtccttttttttgagataaagtcttgctctgtcacccaggctggagtgcaatggtgcaatcttggctcactgcaacctctgcctcccaggttcaagcaatttcctgcctcagcctcccgaatagctgggattacaggtgcctgccaccaggctggctaatttttgtaatttttgtagagatggggtttcaccatgttggccaagctggtctcgaactcctgacctcaggtgatccacccgcctcagcctcctaaagtgctgggatcacaggtgtgagccaccatgcctggcccaagaggtccattttaagttggttagtcaggaagtttttggtgacagtttgaatgtgatagaacttcaggtctgcatgctgaaaacaatactcctcaaagtctaggcttgcacctgattacatcaggataaacaaaagggttctatagccaaacaaatatgggagattctggtatatatataaaaaacttaaacatgtttctttactatgtgatactttagaacttcaaacctacaaaggaagaaatagaatgagacaagatgagaagcagcaaggtaatgggaatggagggaaacttaggggcagagtaagaaaaataaagttggaaaactatagaagatgagagatgaagtcaattaaatagggccatggttgctctttgaaaaatactacccatatgagaacaatacaagcaacaattgcagggtatctatagccatgtgctcttttcctaacgtgactaaactgatggtggtgagaattaggatgatagtagctagtgcttattgaacatgtgcctgatgcccggccttgtgctgagtgctttgtgtgcatggtttccctctctggagtgcagatccacacaggtagaggctgcctctgccttggctcatctctttacttccagcgcttagcacagtaggtattcaataggaacatggaatttgtcttatcagcattaactaatacttaccaaattgatgcatgaattattaaaatttctacaattatcctttattttttatcaggacttacggtacagagaagttaaggagtttggctgaggcccacccaacaggctcaaaagtgatagaattggaagccagatgcagatctatctatccctcgagttcatcctcattcagaatattgccacagagcatttattttcctccatggatcatatcttaaacgactagtgtaccttagacccactgctgcaaagcaaattaacttttccctgaaatgcattctcttcattcttgtactttcgaagtccagggcttctctaaaaagaaattcaagctttcagatgaaaagagcagcagtaaaaagcagggtcatatcgacaagtcacatcaacaattcttttattgaacaaacattaagtgacttacttatgccagaccatgtgctaggcactgggaatataaagataagtaagatagactgagttagtgcacttaataaccttggtgaaagagatagacacgtaacaagtaatgacaaagagatacaggcatgaagaaatacagtgtgctcagggtgcctggaagactagagagcattcactgggaagtaggcagggactggtggtgaggtttatcttttatgatatgggaggcagttaaagggtttttagcctttaaatggcctgatcatatatgaaaatacatataaacatgaacttttaaatattcatacgtgtgtatcacgtgtatacatacgtaagttttttttttttttttttgagatagagtctcactgtgtcacccaggctggagtgcagtggtgcgatctctgctcactgcaacctcagcctctggggttcaagcaattctcctgcctcagcctcccgagtagctgggattacaggcatgcgccaccacacccagctaatttttgtatttttagtagagatggggtttcgccatgttcgccaggacagtctcgagctcctggcctccagtgatctgccagcctccacctcccaaagtgctgggattataggcatgagccactgcacccagccataattttttaaaagatgtttctctgggccgggcacagtggctcacgcctataaacccagcactttgggagactgaggcgggcggatcaccgaagtcagtagtttcagaccagcctggccaacatgataaaaccccatctctactaaaaacacaaaaattagctgggcgtggtggtgggcacgtgtcatcccagctactcgggagactgaggcaggagaattgcttgaacccaggaggcagatgttgcagtgagcaaagatcaggccactgcactccagcctaggcaacagagtgagagtccttctatgtaaaaaaaaaaaaaaaagatgtttctctggccataataggagtaggagggatgaattggaacagacagctctacctacgaagctgtcaaaataggttcactaaaagagatgaagtcctcaggaaagacaatgttctaggaaggattgtagaggacaaatttcagagcaacttagaagataaaatagacaaaatatgttgactaatttgatgcagcatatgaaggaaaatggggcatcagggtaaatcggtgcgaatggtgataccagtactcaggaggaggaaaaagtgtgatgagaagagggatactaaattcagctgtggaggaactctgtttgaagtggtttggggatctccaggcctggagcttaagagaagtgaagatgcagattcagaaagagttggccctaatgtgcttggaggaagataacattggagattattaatttaggaaggatatcttaataaaatgaagaacctggcacataataagtgttgatagagtctagcctgctgcaacaaatatttgcaaccgtatctggagacagaggccaaaggacctagagtgagtttcttattatctgaatgggttttcaagagctcttttggaagtgagttggagaactgctgaaaagacaaggaaattctaaaattagatctgagtatagaactaatgactaagggttaggaatgccagctacccaaatgaggtggagggtgtttctttgaacaatttgcaaacccagtattttttttttttttacacggggtctcactctgtcacccaggctggagtgcagtggcacagtcagctcactgaaacctccacctcccaggctcaagagagcctcctacctcagcctcctgagtagctgagactacaggcatgcgcttccacacttggctaatttttgtagtttttgtaaagacagggttttgccatgttgctcaggctgaccccagtctttaactttgttgttcactctcccatgcacagtatcctcatggtgatttggcagttctgtgaaatatgtgccttattgccttcctgtatgaccctcagtttatttgctgagaacagtgggggctgactgctgcggaactggtgttaatccttgtcaggaaacctcaaggacaccaatattttctcaccaagaaaatattcagatcacggaaacatccttgtctctaagtatctgtgaatttcagaataaagacctatgttttagaaataaggctctttgatacccttttgtttcaatctatctttctaatttaaaaataatgtgtgcctactgttggaaatagatccattaatatctttttatttaaattttttttttgaaatagtttcactcttgttgcccaggctggaatgcaatggtgcgatcttggctcaccgcaacctccacctcccaggttcgtgtcatgctcctgcctcagcctcccgagtagccaccatgcctggctaatttttgtattttaatagagatagggtttcacattgaccaggctcatctgaaactcctgacctcaggtgatccccccacctcagcctcccaaagtgctggaattacagacgtgagccactgcacttggctgatatcttaaatccacattttttcacagttgtgttctatgttttacattgatgggtttgttttagtagcacattccaaattgttagtatcagaaggtcagtgaggtaaaattaaaacaagtactttggaaggttgtaaacatagaataaatttcagcttcatgtaaatggagtgtgatttccataataaagccattattgttgtcagtggtgcatagcaataaagccaaggctgcaattacaaagaaaacagataatacaacaccatactttctttaaaaatggcagttaaattcgtggaaataatatttttcactaaaaataaagagatgtgatgtaatctcaatggaatctactaactcccatgagtagactttcttaatgatagtagcactaattgacgtatctacttgctggtttgttgtttgttgttgttgtttgttttgttttctttgcctttccagaagtaatttctttcactaaaaccttttcaaactattttggttttcacattcgtgactccttgttaatttaagtatgtaaattaagtactgtgatgatttgatttttttttctccctgcagtggaacttcatcttgacacagcctgagttacttggcatagtcttttttcttttttgttaattgtagtaaaatatacataacaaaatttagcatcttaaaccattttaagtgtacacttcagtgtcacataagtacactgacaatgttgtgcaactgtcaccactatccatgtttccagaactttttcatcactccaaacagaaactctatatccattaaacaataactcactattctgcactcctcccagcccctggtaacttctgttctactttctgcctctgaatttgcctattctaggcacctcgtgtaaatggaattattatttgtcctttcatgtctggcttgtttcacataacattttcaagggtcatccatggtgtagcatatattataattttattcctttttaagcttcagtatctcagtatgtttaggctattacagaataccctagagcaggtagcttacaaacagcaaaaatgtatttcttacagttctggagacagaaagtccaagatcaaggtgccagcagattcagtgtctggcaagggcccagatttctggtccatagatgatgccttcttggtgtgtcctcacatggtggaaggggcaggacagcaccctggggcctcttttataggtgcactaatcccattcatgagggctctactctcacaacctaatcacctccaagcagtccaaccttctaattttatcattggtgattaggtttcaacatataaagtttggggggacacaaacattcagaacgtggcactgactaatatcacattatatgcaaatagtatattttatttatctattcatctgttgatggacatttgggttgtttccaccttttggctattgtgatactgccatgaatattggtgtgcaaatatccatttgagtacctgtgccttcacttttttgaatatatacctacaagtggaattgttggatcgtatggtaactctgtgtttaacatcttgaggttctaccaaactgttttccacggcagttgtgccattttacatctctatcaggcatgcacaagggttccaattgctaaatatgctcaccaacacttactatttcttgtttttttgataataatcattctagtgggtatgaaatggtatcacggtggttttgatcttcgtttccctaatgactagtgatcctgagcattttttcatgtgattattggccatttgtatatcttctcaaaagaaatgtcctttgtccatgtttcaaatggattgaatgggtattttgttgttaagttgtaggagtcctttattttatatagcacagtcttatatagatactcatttcttgggtgcaacactgtgtttttagggcctccttttattgagaacattgaaatgattctgttttatcttcactaattcactcctaaacacaacttgtttccaatattaccaattacaaatgctttctttggtaaatattgaattatagacagcagagaagttattagtagttcatcaaatgcgaaataacagcttaggaaatataaaaccaaagtgattttcaattgaatggagcactgtttttcagtttgccaaatggaatttatagtcactgtttaacaacaacatgccccccaaccaactttcatcaccatcaccccctcccaatacctctttccttttgacttaggccctaaagagggttaaaggtgcctcctcagaggcagattaaccataaagctaacgtagcttaagtttcaggtcctttcaccagccttggccccttccaagatcctgcacctaattacggttttgtaacttttgttttttaaagaagcctccctaatataagcttcaggcccacaaaatctggatatgcctctggatatgtttcttctatctgaaatcatcatcctaatcattgttgtacttctggaaggcaagcctgggatctattaagtatgctgagttatttatgactagctttttccttacggagtttctagtctggggtgccaaactactatacttttctgcagaattccaggaaaatataagccatggacattctcatgagccccagtatgctcccttagcttctccactaagctctgtcagcacataccactcgctttgctctaagcacttagatgaacatgcaggccaaactttgaaaattggttcctagttgttcatacaaaatgtgcatgtccctttgtactccgcccagagccataaatagaattttgttcttacacagtggaagaaaagaatgcagttgccagacttgatacctaatctttgaaaattttgtgagcacagcttaggggttttctaaatattagggtatcttgtcagaagtaaaaatgagccttctggccctttagcaaattatattatttcattaaataaaaatgaatttttctaaaaattaaataaatcttaatgtatattttcttgtcctgctgcaaagcattagtgacaaagaaattattcatctacgtaaatcttcttgtattagtcttactttccctgtacagttataataataattttgacaatttgtatatattgtgatgaagggcatatatcagcacggtcccttctaaagccttatttctctctcaaaaaaaaaaaaagtgttcgggttccctttctcctcaccacttcctttctccctctttgcctcctctccttgttctttctttttcctccctttcccgaacaattccatctacagccaccaggtagtacagagcaaggtgtgcatctgcaggaaggggcccaagcctcggtgtcagaagccaatcgttgtgaggaaggaatccatgtgaggggtgcagtgctgcccagctggaattgtgggacactgagtgagtttgggaggccacctgagcgagggaatgggtaacagcaataggaagttggttacatgcaggggagtggatcgaatcagtagatatattaagaataataagcaatagcggggtgcggtggctcacgcctgtaatcccagcatttcgagaggccgaggtgggcagatcacctgagtccaggagttcaagaataatgagaagtagatctcttaccaacacagaaaagttacaaatatggaaagggagaaaactggaattaaccccgtgatgttgggttggaattagaagcattgaaatgaactaatgaatttcaatatatagagatagatagagtaaaacagatctaaatgtgtttgtgtgtgcatatgcatgtgtatcctctatctactaagagagcttaggagcagcaacagcagtgaccatacctagccccagatcacagtttctaaataccattctcccctaaaagaaaccaggactggggcagagaatatttgaaacatcttgggccaaaaagcaaacaactgctagtagaatgatgaggatataaccaaagtcacagaaaccatcttgaaagggctcctgctagggacaacttggcatcgaaataaacaatgatagtggccgggtaccatggcttataccagtaatcccagcactttgggaggccaaggcatgcggatcgcttgagcccggaagttcaagaccagccggggcaacatggcgaaaccccatctatacaaaaagtacaaaaattaagtgggcgtggtggcatgcgcctatagtttcagctacttgggaggctgagaggtggcaggatggcttgagcccaggaggtcaagcctgcagtgagctgtgacaacaccaccacactccagtctgggcaatggagaaagactttgtatgaccctatgtgaaagaaaaggagaggaaaaagaaaagagaaagaaaacaaaaaaggaaagaaggaagcagggagggaggaaggaaggatggaaggaaggaaggaaggggaaaagaaagaataatggataatatgctaaataagcaggaatatattagtctacattagaagataaataagtggataaatcaaacatttgataaggaaaaagatatttacatagtttcaaagaaatgccacatataaaacttcttaattacacaggggaaaatgctaactttacagtgaagaatttgtgcagccatcatcttaatcaagtgaccaaaatgaacatcttcagtaacgggaaaaattgagttcttgcgtcaccttatagaatgctgtaagatgaactcagcatcccttctgtgatttctaacggcttataatctaaatctaatcacgagaaaaatcaaataaactcaaatttaaggacactgcaagaaaaactggctggtaatcatcaaaagtgtcagggttacaaaagtcaaggacacacagaagacccatttgggattaagaatctacgaagacgtgtcaactatacacgactggatctctggatctctctgctaaaaaggaaattactggtataataaaatggaatctgagaatgatagtactatatcagtgttaatttcctaatttgatggcatcatgtttatgtaggaaaatgtctttgtagaaaatacacattattcagagggtaatgggggatcagattcacaattttcaattaattcagggaaaaaaaaactttctcattgtactctacttgcacgtcttctgtatgtttgagattgtttccaagtaaaattaaatttgaaaattgctaaagttgtaagcaactgtttaaatttccatagtggacgaggattttaggtgttaattgatgatagtgggtaaagaagggctttgaggtctgtcatgaaagttgtcagtggtgtggtctaccctgatgtctttcaacagcttgaaaatgtgtttatttgtggctgcaaagatccgattcactttctaaatcttatataacttgtcacttaaatattaagatcgcctctatatggttattattctaaaactcagatagcaaagaaaactcaaaatagacaagtggaaagggtaataaagtcccttggccctgagaaaatctattctgaaaacgtctgaaacaaactgcattagaacatgtgtagaataagtttagttgatcattatgaatcagtcacttcatctttgctcttaaacttaccaataaattttggtgtcttctcagtcagaaaaaagatgtgagtacaggtttttccaacacacacacacgtgcgcatgcacacacacacacacgcacacacgcacgatgttatataatttctgttcttaagtgcctggttggaatatgctaatttcgggagcacactactgcctgccattttctggtggaacagtcttttaaggagatttctacaaatccattgttgctttgtggtacttactgaacagtccagcaggtggtagtctaggagaggaacagttctcatcctcccccagccatccctgggcctaccagcagccccatttgcaaaacagaatgtggactcagcaatgtgccttctcccctctggcataagaatgggatttccaaggttgttctctcaaaatgggcactagaataccacagaaagaagccaaaaataactgtgtatacatgtgactgtgcagtattctgaagctcaaaaattcttttttttttatttctagaaattccactgattttatatctctttgctctgatttccgtgacatggctttggggaggactacacatggcctacagacacttctggatgttggttctctttgtcattttcaacagtctgcaggtaagccttacaatttggttagtgacaacatacatttatcttaatgaacacaaggcatagaatttcaatattaaagagtcaagcatccacacacaggtgaatttgtgtacataataacatcatatagagttgtaaaataaaatgataggaacctaaatccttaacatttgaaatatgactgggattctaacttgctcattatacaattagggaagacaaaatatttattctccttcattttgaacatcgaagtaactacacaaacatatttctttttcagtaggattgatgtttatcaactttgcaaatggcagtcatgtaagatcaatgcacatatttggattgtggctgggtctagaaattagatcaattgaggagtgaaatagtgatgttcaagcagtcccctcttaagtgtgatgcttagtgaaatgagagtgtttggttcactaaaacatgactgacatcccctaagtccagcagtgcccagcttaaattagttttataagcatgcttggataactagaaattatataactgcagcaaaaatgaaagctgagatttttagtacttttgttaaatggaaaaatgttgcaccctgatattaacaaatggaacaaatgaacacattttccttgttttccaaagtgaaacgatctgtcctagactaaaagaatttcttaaatttattaaattatctctaaatagtccttcttttggctaccatcttgcaaggatcatgtgtggcaaacacacagacatatacacaccttcagaattgtagcatacaattgaaatgtgactccagtcattttttaggtttgcacctgagcagacaaactcttcagttagatcatagcttacatgatggtgcctaatcaaggacattatcaacttaggaaggggaaaatacaaaacaattaaaagtttagaaccaagttgctacaagtttctatatagacaactgtctgtggttatagttacaggtgagcacttactattgccaggtggtaaagaagacagtccggcctctctgggatctgatgattcaaagagtgaacaatcagctctaagaatctagtatggcaggtgccatgtaaagagagcattttgagagtgagtaggggcctgttgaccatcagggcagagccatcagggcagaggctcagtcttggtcacctttagatccctagggcctagtggaactaagaacaaggtccaaactgacagcctgcaggtgtgttttgcttggcagacacacagtgttatatgaaagattgttttagattttcaaatagttgcttcaaacttttaaaattgagaattttcacattaaaaacctgaattgctggctttttttgaaggcagtatttgcatggcagcaatttccaagccctgagcagacctgatatacttcattcattttacttgcccctgagattatgacacatttaatgcttattaaataataaatgagtgtatggttagagatgggaatttcaggcagagaaaactgttagccaaggctgcaagaagggaaaatgactaatctcgcctagattaagcaacgtgttgagaaggaaaaagaaaggtcttgcaattagagaagaagttgtaggagaggagacagaaagggtagattggtttaaacgccggctttccatgcttgggatgctgagcttcaatctttaagcaaggggaagccatcgaagttgtgatttttctttgtattgttctaatttttttaattttgtcaattaatttttttttcattttgaatgggatgacatgtttgtactggaaagataactggaaatgtttaggagaggatattgaaaaaaagagcagctctaagtaggtaggttattgttatatttcagactgtagatgttctggcagtgtgcctgggaataaaaagtaggtgacaggtttgacagttgttacagagataaacacttttcattttattgtttaattgacacataataattgtatatttatgggtacatagtgacgtattgatacatataacatgtagtgatcagattaaaagaattagcatatctatcatctcaaacattcatcattactttgtgttgggaagtttcaatatcctccttctagcactttgaaactataaaatattgttaactatagtcatcctgtagtgctatagaacacaagaacttacttcttctatctagctgtaattttatatcttttaacaaatctctccctatcccctttttccccctacccttcccagcttctagtaccctctgttctactttttacttctatgagatcaacattttttagcttccacacatgagtgagagcatgcaatgtctaactttctgttcttgggttatttcacttaccataatgtcctccagttccatctatgttgccataaataatattgggttgatgcaaaaataattgtgatttttgtcattaaaagtaatggcaaaaactgcagttacatttgcaccaaccttttcttttctttcttttcttttctttttttttttttttttgagacagagtctcactctgtcacccaggctggaatgcagtggcgcgaactcagctcactgcaacctccacttcaggctcaagtgatcctcccaccttagcctcccacgtagctgggactacaggcacatgccaccatgcctggctaattttgtttgtttgtttgtttgttttgtagagacagggtttcgccatgtttcccaggctgctcttgaactcctgaactcaagcaatccactcatcttggcctcccaaagtgctgggattataggcatgagccaccgcacccagctgtcattcttttttatggctgaatagtattccattgtgtgaatttaccattttccctgtccattcattggttgttggacacctaggttgattccacatcttggctattgcaaatagtgcagcaacaaacatgggtgtgcagatgtctcttcaatacactgattttctttccttaggataaatgctcagtagtgggatggctggatcatatgtagttctattggcaattttttttacgaacctccatactgttctccatagtggttgtactagtttatattcccaccagcggtgtagaagagttctgttttctccgcatcatcactagcatttattttttgtctttttgatgatagtcatcctaactggggtgagatgataattcactgtggttttgttttgcatttccctgatgattagtgatgctgagcatttgttcatatatttgttggtcatttgtataactgttcagatcatttgcctgttttattcagattgcttttgctgttgaaatgtttgagttccttgtatgttctgcatattaattatctgtcagatgaatagtttacagatattttctctcatcttctaggttgtgttttttactttgttaattgtttcctgctgtgcagaggctttttagtttgacataatcccatttgtttatgaaataagcattttataaatgctttagaacattggtctagggaaagattttataaataagaatctttagatttttataattttataaatagattcttattatatttataaaccttttatttatatttaatagcctgtaaaatcttttatttatatttaatatccttttatatttataaaccttttataaatatgaatctatttataaaattataaagtgaagcatttcaccttgttttcttccagtaattttatagttttgggtcttacatttaggtctttgatccattttgagttggtttttgtatagggtgagagttgggggtctagattttttcttttgcatgtggacatccaggtttcctagcgacctttattgaagagactttcctttccccaattaatgttctagctgccttctgtcaaaaatcagttggctgtagataatgtggattaattttgtgcttctctattctgttccattggtccatgtgtctttgtttatgccaataccatgctgttttggttactatagctttgtagtatattttgaattctgatagtacaatgccttcagctttgttcttttgcttaggattgctttagttatttgaggtcttttgtgattccacacaaattttaagattttattttatatttctatttctgagaagaatgtcattggtattttgataggaattgcatcaactctgtagattgctttggctagtatggttcttttaacaatattaattcttctgacccatgaggagcatgagataactattaatgaaatttggttaaccaattaaatataggaaggtaaagtgtgacagaggaacatcacttagaaattcctggtttgaatgaatggctgggcactgacatctttagtccaaatggagatcacataaatagcaaggtctagggaataagcagtgaagttggtgaaatttaggagacgttgctaaatactgtataccaatgttttagcaactgggtacagagataaggctaatgaaagaaattgttaatgagtgatcagagagctaggaagagaacctggatagggtttgcagttgcgggtagaaaagaaagctcaagaggacgcaatgcctaactctggctagtgtagcagagaagttaaataggatgagaactgaggagcaatgcggtctacagctgtggttcccaaaccgttatgtgtagcagaattccatggggagcttgttaaaacacagatgataggccccacacccagagtttctgatacagtaggtctgggtggaatctgatcatttgcatttctaataagtttccaggtggtactgattcggctggtctgggaactacagtttgagaaaaaaaagtgaaatagagactgcaaagagagaaagaaatagcttaggaagggaggttggttggttcaaaggagattttttggttttgttttctcgtgacaagaaccaacaaaggagaaattgacatctggaggaaagatttgttgccatggcaagatcatggacgaggcaggaagaacagaagagatagagggcttctctgagggaggagtaggaatgtttcgttttgttttgtttttgtttttgtttttgtttttgtttttgtttttctctgaggctggggaaagaaaaaatgattggtgaacatgaaaaactactctggagctgaaagtgtggaatgttggcatttgcatgtaatgccctctcttttctcttaaaggcaagaggcaaggtcatttgttgagaggaatgggttcaaagcatgagataaaaattttaaaaaggtatggagcagtttctagacagaacagaaataacttaaactatgttgaaagatcatcaagaaatggattgcttagagagaaatcagtgggatccaatggagattagacaacttaaatctgtaattgagccagtcagcagtaattaaataaatataagccttaggattataatgatagcctgggtaacctatcaaatcacataaacaggaaaagtttattgagctcttatggaggtttgtaaagaaaggaggactgtgacacataatagtatatgtcactggtacatataagaaaaaattttggtctctttctttgaagaacttattagaagctaagaataagtaaaaactaaaaatattttaaactcatgtttaatgagcttaattcaatccaggtgacattactgaagcagcaatgattatttgtactactgttggttgttacctggcgcactggcacattcctggtaccagatgcttagtgaatcagtcctaaaagtaatgcctattaagaaacacttggaaaatatcctttctctggagtttattttggttcatttaacttaaaaatcgcttgaggtattcagtttaggcatttccatggaatatggctacatagtattaacagtaagattttttaagtatgttccataaacacttgtttgtttttttaccccccgaatggctttcatatttctctactgattttatcaacacctgtgaccataaaagcatattatgtatcttatacttgcttactacattttgctcagaggagattactgacttactttttatctagattattatgatgtcataggtgctctaaaactatgattgaaagggatggtatttgtatagtattctgatcattttaagttttttaaaaaatatttttaaacacacattctagaatctgagatctcaggatctctagccacctctgtcctctttctctacagtcttttttttcctttgagacagggtctcgttgtttctcccaagctggagggcaacgacgtgatcatagctcattgcagccttgaactcctgggctcaagcaatcctgcctcatccccacaagtagctgaactacaggcacataccaccatgcctggctatttttttatttttatttttttgtagagacaaggtttcactatgttgcctggactggtcttgaactcctggcctcgagtgatcctcccacctcagcctcccaaagtgctgggattataggcatgagccactatgtgtagcctgattttttgatatttagtgtctgatgcactttaagtaagaaaatcttgatcacttaaaatattatctaaaatatttacctaaaatttatcacttcctaaaatttcaaaggtgaactaccaaacttacaatacatttgcacatttaggaaaatgtatgtgtaatattttgcaaagcattatggatacaaatgcaaatgtaaggtttaaaaatcatcattctaaatgtttactgttaatttttattgttgaatactcttctttaaacgataaggacttcttctcgcccaagaactgaacttttactcaaattcttattggtctatccttattatttacattttcttgatagtttaaaaaattaaactgttggatatcaagagtgagcagaacatagagaatgaaggtgaaaatgccctttcagtttattcaatcagaattgtttcctaattccagtagctactatataacatgtgagcatgatcatgataattgtgtttttgccacttccccatgatgtgaggttaacaaatcctgattttcactgtgctttattttatgtcaaaagagggactctgacttcaagagagaagaaaagtacttttgtacttacatgcctactgagcccagattccaaaggccttggggttctatgtttccttaacactgaatgggctttccaagtgcattgatcatggtggctgccacggtgcaagactcacctcctgccagctttccagccccagcaggaaaaagcttattcctagataacaaaatcctatggaagaccagatggtaccatcctgggtcacatcccatgcaggaacaaatcacagggtaacagatactctggccaggcctgggtcatgaacagcatccaataatggaaagagtcaagttggtttcataaaaaaccacatggagtggaattcctgccagaagaaaggattctctgaccaacagaagggggcaacagtgcttggcaggccaaagtaacagacgtccactatacttactttctaaatttgcttgttcattgatataagtttgaacaaggccaatgacagcttctgtcacaaaactaggaaactttatcagtgtgatttcagtttattagaatagtacttgtgatctatcatataaccaaatgtctctatattgtccacaagaaattcataagaaactatgtttaatattttttattttcccgttccattaatccaataacctctattttaaaaaaattgagttgagtttgtcatttctaaggggattcatgctaatacttataggtcataagtttcttaaactattcaggccaaggtatatccaaatttatatcatcatttattggtaataatcacctggggtttatactcagctggtaggccctggcagaaccctatcagttaaaatattgaaaatagctactgtccaaaccttgcaggtgttccaggcttccatccactgaggttagaagcatctctaggcttcctgacagggatcctccaggatgctagtgcagcgctagacctgcagccattctgattgggcaatgcttatgccacactcattattaaatattttgcatatcactcctagctctaattatgtgctgaaatattctttttaacctgaaccagtcagattcaggctgaaatacagcatttatttcaggttttcttctaggagttctctcacacttactgtgttagaattttactgacaattttctcacatgtagagagaatcccatgtaagataatgagagtagccagcagtaatagacatgagctgcttggagatgctagaaaatacgtttgtggagaaggttcatatgcatagaagctttccaaaatctgaaacgcattcttcttggaatgcttaacctggcaagtgagcagagctttgcacagtgttgggatatgacacttctcagtatgtcagttatgagactgcattctccagagtactgtttgactgtttctctgtgactgacttgtacatgttcgtttgtacaagcatctggtctcgagatgttccctggcacgttttgaatcattccctatttcagagaggggagttacaacatggaatttgtagctaaaaatatatagtccatcttcagacttaaagagccagttggttaaaatcattttcattcctatccccatgtcttaagctgctaaatggttgggaaataagtgattgaaagatagcaacagtttcttccacctgttttttaaaaattgtcctttggtggtcactagagtgtcttaaacacataaaacatttctcttatttaaaataacaaacagttctctctctctcactcgctctcttactctccaccccaccctgccttttaccctttcttttcttgttttctatgtgtctctcgttgctatatgttgaatttcagttttaaaattaaagccatcttttatgaagagattttcccaaatgaaaatagtttttgaggtatcgtaagaaatggaacgtatttctttgctcatagaaaatatagattccatcccaaatggaatattggatcaaattaataatcccccttcaattcccacttagtatccagaagggttcagtgcaggtgtctgcttagatacagtacatatttagtcttggctgcttccttttgaggataaacagctcttgggaaatacacattgttaaataatcagttacagaggactaattgtttcaaggcactccctttgcagttgctttccaacagccaacagtaataagaaatgtcactttgtttccattggagactagcacatgaactattcatgaagagcggaaaagcagtcttcccagaaaaccctggaataaacatgtagaagccaagggaggctgggactctatcattgatttgtcccagagccatgtcaaattcagtgaaaaaaaaatcactacatttgttttctagagtgagaattcagagagactaatgaatgcctcatgcacctttcaaaacatccccaaaggtttctataacttcacaaataaatatatagaagctgagacaaggaggtgtacttaaattttcttaatcaggttatgcctctctgccccgtgttcagtagcatctgggctggtgaaacacctctgtgtttttgagcaacaagctaactccatttcacaatgagtgacagtgtctgacattgcctgctcattagcctgttgattgaccaggcatagttctttagatagactgcaggattttcacttttgtttcatctggattctctaaataaaagtgtcaaggtctgatctgccagtaaacatcttccacaaatatagttttagtaatgaggggcttgaacagactataccttttcatacctggctccctccttccaaacaggtgcctccatttcttctgctctaattcgtgctatcttttaatcttttaggtttttttcctgtgatttttccattttctgagcattctatgatcacatttattgcatcttaaacaatgtgttaataacatgcttttcctgggctctgtgagcctttactttgcctgcaaaaagatctagcacactccaatacttgaaagagcaaacctacaagatttaaactaaacaagatgcgtacgtcctctttaagagagtttgggagagcaaagcaaatgacatttgggactcgtttttacctggtcattcagattctttgtcttcatgttaactgataattttttccaggatctaaaactttattcttctctctcatattactcaaatgttggggtggggagaatacattttttaaaaaaaaactttatatgaatattttacaccaacattttgtaacgttcagccatcagatttagtagaaggtgcatgcagttaagtgtcaagcaacctctattttaccaagcaacgtgagttatccgcttttcagaggtgctgattttgcctctaaattttgtcctaaggattgtgtaaaaatatatgtgtataaataaaatctgtaaactatgcaatattttacaaatgcaaatcattatagatgaataaatgagcaaaaagaagtgtttatctcaggatatatataaagaaaactgagaggccaaagagctgagactgtaaacctagtctttgactcttctcctatggcataggctctccccatgaatgttcgcattcacccacaggtatttccttcgtgcagatcctgtagctcctctgtaactaccatcacattccttggtttgcagtatagatctgttgtatgtcattcacctgctttcagatatgtaccaaatgcctttaggctcaagcaggtaacttctatggctgaaatatgcttattgtgagactatagggatcagtggggactgcaaaagaactggagaactcacactcctcctaaaagcactcaaatgcaaatgaaaaaagcaaacactgtgcaggccaagcaaaagctgttgcaggcgaaatttccatggatggcagtcagtgtgcaatctcaggataagttcaaatttttccctcttaagagaatttaatttcttttggaaggcaaattgaatataggcagaccaccttgatccagtagaaaatgggtgtccacagctcaaagattaccttcccattgaggccttcctttacctcctctaagagagtcagttgttccataattatagtccctcagtatattctgtatatattcctaataaatcctagcatattgtatgattagaaaaagaaataggctgggtgcagtggctcatgcctataatcccagcactttgggaggccgaggtgggtggattccctgaggtcaggaactcgagaccaacctggccaacatggtgaaaccccatctctactagaaatataaaaattaactaggcatgctggcatgtgcctttagtcccagctactcaggaggctgaggcaggagaattgcttgaacccgggaggcagaggttgcagtgagccgagatcacgtcactttactccagcctgggcaacagagcgagactgcatctcaaaaaaagagaaaaaaaatgccaggtgcagtggctcacgcctgtaatcccagcactttgggaagccaaggcaggcagatcatgtggtcaggagtttgagaccagcctggccgacatagtgaaaccccatctctactaaaaatacaaaaaaattagctgagcatggtggcaggaggctgtaatcccagctacttgagaggctgaggcaggagaatcacttgaacttgggaggcagaggttgcagtgagctgagattgcaccactgcactccagcctaggcaacagtgagagacttcgtctcaaaaacacacaaccacacagaaagatggctgggtgcagtgggtcaagcctgtaatcccagcactttgggaagctgaggtgggtggatcacctgaggtcaggagttcgagaccagcttggccaacatggtgaaaccccatctctaccaaaaatacaaaaattagctgggtgtggtggcacacgcctgtaattgcagctactcagaaggctgaggcaggagaatttcttgaacccaggaagcggaggttgcagtgagccaagatcacaccactgcactccagcctcggcaacagagcaactctgtcaaaagaaagaaagggaaggagggagggagggaggaagggaaggaaatgggtttcaggccatgtgaaggttaaccaatctatttatagttttctctctcttgagacaaagtggaaatttgttgaggggacccaggactccagtgaaagcctattgtgttttgtagaaacctcccctccttgtctctgaactccattttttcattccccaatactatgagactcttgaattcattactgagcttcttagcttctgagcagctgctttctgcttagtccccatagcctttcctctcatgcacaggcagcttcagaagtggaacatgctgtcatttcctttttctttggaatcgtggcccctcaagtcttggctgccttggaggacttgaactctgttgtttgtctccccaaccctgtcagattcctgcaaatcccaggctgcaattttctgttcagcttctaggcatctcactgtaaactagaaagtccctcagaagaaaaaacaacgctgaatatagggctccccaataaatgggttttgcttctctccaggatcttggcccttcaactactggctgttttgaatactctctgatgcctttcaactcattttgttattgttcttgttcttgtgttattggttttgttcatgctcctatttttgttattgtgtaagtgtgtgtaaaaacatttttctccagtttacatagttgtactcaatgaggttaatctgatatacactactccatcagagccagcaacaaaaatctcaatacatttatttcaacaaattatatctaataattgttaacatatactgattgcctactaataaatgaagatacttagaggtgctgaaattcatcagatatttagtggataccttttaaggcatatactcctgggccggcatcctaagaacatcatgatgaggaagcctgtgcatgcaacatcttatggtcagctgatgaactgtactttttctcatatatcaccaaaactaaaacaataaatatggaagttgagtaagatcttagaatctgtaatccatcaattgaagattgagcttcagaaatgatatttcagcttcagaatgaccacacctatctcacaaaactgaaataaaacaatagggaaaacagactggccaggtgcagtggcttatgcccataatcccagcactttgggaggccaaggtgggcagatcacttgaggtcaggagctcgaggccagtctggctaacatggtgaaaccccatggctactaaaaatacaaaaattagctggacatggtggtgggcacctgtaatcccagctacttgggaggctgaggcagaagaatcgcttgaacactggaggcggaggtggcagtgagctgagatcatgccattgtactccagcctgggtgacagagtgagcttccatctaaaacaacaacaacaacaacaacaacagactaataacacaaagggcaactacaactaaaggtacttgcgccaaatggatagcactccaggaaacagatctgccttctcagaatatggatagaaaaatgtcaactacagttctactgaaaaaaatataaagagcatgaattcaaatataaactgaactttcttcttaaactctttagatagataggtctgggaagttttattttcagtcctgcagaataaaccaattccatgtcaccattttcctctgcaaatattttaaataatgttctctttactttgagaaatggcatgaaatagcaaattgaaaataccttgaaatacaaatcctgtcttattaatttttagttttgtgattgtaggcaaattatgtaatttctctgaaatgaggatagcactacttactttacaaggcacctatggaaatcaaccaaagaatgtgaaatttccagcacttaactggtgtgtattaacattaactgcctttctcttgtccctaatatgataccatacatgcatatgtgtttcatgtaagattacttcacatagtgtatcattgaaatcagttagcagtgttttctctaattcccttcagttagtctgattattcggtctcttcagaagcccaatgatgtcacaggctgcatttactaagctaccaactcagtgatcttatttgtaaataagacctcaatgtatgggtgctatataaatgtgaagtagacataaaatctgcctgttatatttgtcctttgttccataattaatgttttgggacatgttgggccagtaccatactgtcagtcttggaaactctcagttataaagtggtaatatagtcaagcattgcaaaaagggggccactaccctaggtggataatatttaatttggcatgtgatacttaggaagaaaattggtaaaatcaggattggctcattaccttcataaagaattttcaggaagttttgtttgcatgttgattgctagaatagggagtacgcagaggagtactatgcagagtcacctatcaggaatacaattattagctaagactaaataatagtaggtaagaagtaggtgaagtggaatgttaagatggtcatttaaaaaggtttgcaagaaaaatctaatatgtaagcatttgaggaaaacaaaagaatttgaattcatcagagtattcctcatagcacaattgattatcaaattttatagtaaaatttttatttggaaaatttgtaatgtcaaaaatataaagtaaattatacatagtttattgtttgaaccaatatcataacactggaaatcttatatttatttatttattcattcattcagaaacattaatctatccagactatgttcatgtatgtatttgtagactggttattctatgccctcaatatatattataataaaaatcagaacaagaacaataatattgattaagtgtttattatgtggaattgtacttatttcattaaatctttgcgacaacctgaatggtagggacttttattcctgccattttacacatggagaaacaaagtcttagagacttttaggcaaggtcacatacccaataacatatgagcagggattctataatcagtttcttcatcatgcactgcaacgctgaaagaagagtaccttttgtattatattggaaacctcagttttgccttttactaaaaccatttactcaaatactacactgaaaataattgaataactgtacaataaatagcaactcaagagacacaaataatcacttcatagttaaatgctaaactgatgatactgacaataattccctatcacttactctgggtatcattgggaaagttactcagtttctgtaagcctcaggttccctcttcaaaaagtgagaataataatagaacccaccttaggactaggactgttgagaggactgagtagtataaataatacatgtgaagcatggccatgtgtgcaaagcaggaacagtgctcagaaaatattagctactcttattgtcagggtggtggttgctatctagtgttatttgtaattattcttagcaataataataatttgataagttcacaggaatatctagaaaagtcagagatggctttaggaaagatgtggtccttagccaggctgtaaatgttaccaaatttggatgagtctagaggcaaaggaagtctcttcaggttcttcatatagaagtcatgaatgggaaaatgtacaaggtggggagagcatagttatccttgtctggctggaatgaagcttatgataggagaataaagggaaatactgttgaaaaggccttgggggagggggatggtcacatgagcaaagtctttgtgccacgctattatgggatctatttaaacagtttaaagtaattggcaaaaaaaaaaacttccaaaaaaattattttttgtaaataccataaccactgcaattattgaattctggccttttgcattctatctataaagacaagtccaaagacagccaccagggagtttattccgctggaggacagaaccattatcacggatgcttttgctccttccactgatactgactctgagaatgagctcagagcagcatgaaaggaatttaacataaataaataatacataaatgcataaaacacaaactgtaatccagagtgtgatcttcttgagatcaggggccatgatttaaaaatctcccatgcctctcatagttgtaacacctcttacagtgctaagaacctactgaattgaattcctcgagcactttttttttaagacactgaacaaatgagcactgaagtgaaagaactttatctaatccttaaggcatagagaatggcaccagtcaggggccctctgaacttggcactgcttgtatctctgtgaactcataggggattctctttttcttttcctgtctccatctctgtttcatcaactagaacttatcattttcttctcctttcaacatctgttttctattgcatcccattgttttcatttttcatctatcttgatcattctcatacattcacagctctgttagtaatcccacagataactatgtatgacttgttctctgagagagcaagcctttagcatacaaggactcaactctgctttgaaaaatcaaacaagtttttaaatccacctaatagtattcatcagggaattttttttatttttagagacatggtgaattttccaattcagtaagagcaaaaagaaataataaaacacccagatttgtgccatttcagaatgccagtgcacattcctagtggcagttaatactggcaggtgctgtgaggaatcatacataggcaactgggttcctgaagtcagccaagagttgattgcttatgtttttagagctgtgcgaagaagaaaaatgtaggcacaccactgctgtgcagtccacgggagtcttacagctgcaggccctgaagcactttgaaaatcgtccctaattgtcttttgcctctgtgttaccaacttatcgcctacccccatggtggctttcatgctgtgtgtcaccaaaagctagcctctgctattttctaaggaaggaactggcagctgttccaaagatgaaatctaaatgtaatctccatagttgcaggtagaagcaaagtaaatgttttagaacttttcttatcttgacttcaggcatcatacctcatatttatcaactttgtagccaactttagggcaaacattaagaaataaaaaaccacacacatccacttctcctttggccctcaaaagtctctccattggcatgactttgtatctttatattggcaaatacttggctcaattatagaagttatagatcttcctcactagcacaagtcttttccagcccaaacagctattggatttgcagacagaaggacagcagagactgcagcactttggctttgcttggcctttcggacccttttggcaaaggaaaatggttcttactagtgagtgcctatccagccttaggcagctcacaggcaagtagaaaaagtgtagaaaaggtgagactagtaagaacaaaatcttgctagagagctactgacaagaacatagcacttacaccaggtgatcacttggatactcagggtgattacaccagacgctgcaaactcctttgtctacaaaggctggaagcagactcgcctggagcacgtggtcaagtgggactgtgtcttgtaaagagggatgaagggagataaaggggcaacagctatgtggcttcggttaaacatttgctggacaggaagcagatccagtgtcagccagatcttctgatttttctagagaagccagaaaccagattttttatgtgaaacctcctaatttgtgaatggtggcaagtatttaagacaacttttaaacactatgtgggccagtcacaaactgtcggcaggcagtattcaagctgccagtttgtggcctctggcttacctaataggcattccctcatagtccatgtggatcaggaaaaagaaatttttccagctttgtctatcttttacaaattttctacactgaacattttttttttctaatcagagttgttttcagagcttttggaccccttttctgaacatagtctggaacaaaccccagctcccagggtggcctcaggatgatccatccccttgagtgacctcaagtccatagctgatctgagaagagaggagggagagtctggacattcggggcctgttctagactagtacaaaacactgggctccacctggctcagtactacagatgcaggggaggcaaaaagtcactcattctaagtcaggccagaacctctttagctgtgcttggcaatgtggagtatagctgtacagaagggaatgagatgctgtgggagacagaagagatatgaaagtatagaatggggccaggcactatggctcacgcctgtaatcccagcactttgggaggccaaggtgggcgggtcacttgaggttaggagttcgagaccagcctggccaacatggtaaaaccccatttctactaaaaatacaaaaattagcctggcatggtagcagacacctgtaatcccagctactcgggaggctgaggtaggagaatcgcttcaaccctggaagaggaggctgcagtgagccaagatcatgccattgcactctaggccgggcaacagaataagactctggctcaaaaaataaataaaaaaggaaagtacagagtagaatggggagtataggggaacactatttatttctagtcctcaactataagtaagaaaaataaatcaaaagtagaggtgctaaatcatgagaccatgggagatgctcattgctcctttctaacttgttccatgaatgcacccgtccttgtaccacactattggaaatcttcaccacaaccagaagccgtgccaggggtgcagtggctaggatggagacaacaggctatttttgttccaagtgaaacagtaggccaagtgaacaggtaaatacatggggcaactcaaaagggatgtcaacccccggagctgatgggtgtgtttcttctttatggtgtgagagtcgggccagaagtctgggtaaccaagtcaggacctgcagtttgggcaagattcgagctgcggttcagaaccacagcattggagacaaaagcaagtcctgcatgtccagtgtcatctgggccttgtggttttttcctttcttcctttttataatggattttttttttcccagagagaagatgacatcagccaaatatgagatacaggctcaagtaattaaatattttttggtttatttacttgtgattttaaaagaatatgaagcatgcttgggagacatttgtgtctggaaagagttgagcaactctaaagccgtagcatgcagcaattggtgaaaaattgctaaattatgtttcttttttttccgtgaaatgtcaaatgttgttcttttgcttctataaaggtcagtatggtttaaagagaagaaaaaaaaaacaaacttggaccattaacttgttattgaacttcaaaagtgttgtatttaccagtaaaaataaatctaaaaatgttttggtggctctgaaacaagaaagactagattgtaatcaaattagtgaatttctggtactttcctcttctttctgggtctttccgtgaaaaacaacaaggagaaaactaattcaacagcaaaagttgtttataaatactctatatgttgcttatttgtggagtatgagttaccacactaggtgagtggggtgtcataattttcccctcatgcttttctgccctttgatgttcttgaacaagaatatagctgtggaaatataattcttttaacgaatacatttcacagtggcatttcccaaatggtaacaagggacttactccttcagcagaaaagtcatctcctttttataactgatgatgtacttgtatacacacaaacacacataaagaaaagcagaaagtcctatttgttcaagtttattttctaatagccattgttatttattagcactctctgctctagtcatagcacattactacttcatacctctttttgggaaaattattttgggggaaaaaataaaatagcattacttaacagtgtgaagccataagtttttattggattgtatcttataatcttatttcaaaggcagagggtaggctggcaaaatgtaggccaggaaatgattattgttgtccctgacagaacacatactagtgacattttcaaaatagaatatgcaaaagtttatctttagtagctctgcacccaactgccaatgtttttctctttctcttgccccctctccgctactctctagcttgtgttcttttgctgagcttggcttactctcagttaatccctgctaaagatttcacactgctagtgtcagatgtgcttcctgccaggatactggcattttaaagagggactcctagacttcctgcctgtttctcctactcctggagcgaaagtgaacatacaaaaatcaatttcccctggtcatcctttttccatggcattaggaagcacagcctctccaccatgctcctggattcaaatcctggctctgctacttgctagtcctatgatcatgggccagttacttaacatccttgtgtctcagtttccttatctgtaaagtgaaaaagatgattatctcacagggttgttgggagactgaatgagataatatatgtaaaacatgtaaaagagtggctatacgtaataaatacccagtaactgttcattattatgttattattctgtcttagtccattcaggttgctctagcaaatataagggtaatttataaacaatagaaacttatagctcatagttctggaggctgggacgtccaagatcaaagtgccagcagatttggtatctagtgagggcctgtttctcgtagatggtgccttctctgtgtcctcacatggcagaagagcaaagggaaaagggggctaacaagctccctcaggccattttatatcagcactaatcccattgatgagggtagagccctcatgacctaatcacctcctaaggccccaccttttaataccaccacaatggggattaggtttcaacatgaattttggaggcaattgccaaaccatggcaattcccaacattaccatccttgttttataaatctcgttttctgaattgacttataattacttctccattccctgagctaagtatttattgtattagagccagaagatgcttcatttaaatcagttaattaatttatctattctgttgcaggaactgttgtatgtgctttggctaaatcacaaaatagacaaaatatctgtctgttagcaaaacatgcaaaaatgcctgcccttgagaaatgtatatcctagcagggagtggagggtgggtgaggtagagacaatagatagataattcaaataaacatgactagattatgtagcatgttagaagatgataaattccaagtccaggagagcgaagggcaggccagtgggatgcattttaaataggtggccaaggagaaggccttgaaacgtttgagaaggccattaatgagcacgggtagaaggaagccagggagagtctcagtgtccgtcttcagttgcttttacttcctttcatgattcacatagttatttttaaacttttttactgagtagaatttttttgtgtgtattaattctgagtaccattattcattacagtgagttccatcacattactagtaccacaaagataatatctttgagactaaaccttttgggctattttttgtcctttatcctaaaattttctattgtgtttattatctggtatatttgaatttatctctccaaaatcaccacaaaataaaatttttaaatgtttgtcttgtttttctctcaccattaagtggggttaatattaggttcattaggtaaggtttaattttaaattgtggccatctgatattgctacatcaaaaggaagttaaaatttgcttgcctaacatcacttaccaatgtagttgtactgtgagcaaaaatagaacaaaaatagtttatctggagattgaaaattcccagtattgactttagcatgactgcaaaaaactcataaccctctagtgaagacccctgaagttaacataatgaaggatagaaaaaaatgacagatgggacaaaagcaaacttcctggtaaaatgtggaagtattcctcaaaaaaggctgttcataataaacttgggtattttagttacggggtcagaaagaaaaattttagattgatttatttagttcagagaaattacatgaaaatataaaactgtaaacttttctataatgctctcttttatttgagcttgtatgattttttctaattaatttctaaagacattttaactattgaatactaaaatgaactatcacttcaaaagtgagatttaagagtctctagaactatactgtttgtatttataagacagaggagaagggataagagagagagccaaagacagtcccttggagacttggggtttcagcaactgtgccacggggcagtgcagacctccgagtgaccaggttttcagtccaggatcttcaagactatctgcagtaaagccagcagagtggacagaggggaagtcacacactgcctttctttcgtcttcctattgcatgtattctcaacactcaggacttgcctcccctgaatggatgagagtggagaagcacagaggttgacatcccctaaacttgtacgagagtcttttaaactctgctgctgacatggcgtacaaacagtggtctctaaaagtgcatttcattcactttgggtaggtcatgcattataatatcatttccccccaaaagtagctattactattacttccttgaaagggccaggaatatacttggaagatacagtgagagctacagtctggagcatcacagcacagagctgttgcctgatccctgaaagtacattgacaatccctaaggtccatagagaatccaggcgacactagtcttgggcaaatcacagcatagagttagacttggaatcagacaggcctaagtttgaattccagttagagtgccatccctaaatcccagtaaatgaaataacacataatatgcttagcccagtgcttgccacacagtaaacactcagtaaagggtagctttattatttttttcaaaggaataaaggagaagagttgcacggccttaaataattctccaaatttattttgagtgaatgcattttgtgctagagcttttcattggtaaccagatcaacagagcttagaaagcactattttgaggtatatcagatgaaatgaacacatgcagtgattatgttcatatttgatacagagggatcttatttcattgtcgtcttccttctaccatgctatatccatctgtagttctgttttcctttttaaatgtttcaaaccttacctttctttggaatccagctttaaatggactacttccttgaagctttccatgcccactctagtttatagtaacatcttctgatgcaacccccacctcattgcattccatattttcactcatttggcacctcatcatacattgcctggggcagttccctaaccagttccctgaagacccactctcttggttcttttgtactgcctgtaaagcttaattacagagctggcacagagttcccagtaaattcttgttgaattaaatctcttatttgaaatttccaatgcctccactccccttccacaaattctctcaatgtagggaaatctctttagatgactaaccggtgttaacacctcaacccaaactgacattttcaaattatttagatgcttcataattttccagtgtgttctaccaaaacaatgtttacatgaaaagaatataattattcaacatttttcctaagactatggtaaaagccagcagcattgccccacttagaggagctaaaatagctaaaggttacatgctttgcctcaaataatagacttagtgaagagggtagaagtagaaatgaggtcagccccccagagcagtctggtggccttgagcaaccaggaaggtaaagccggtacctcagttaaatcaccaagtttactggaagtgcatatttttcatgtgccaaattcagtaagtcatggagcaaatgtttattttgctatgctttaaaaagttgctttgcttcttgtaagttttctcagtggaagggttccaagttatgacttaatctatgtttgcagcattgcactggaaacaggatttgtctgtgaaatggctctgtcatttgtggaccacttctgtagggagattgtggatttaggaagggcagaagcaacagcagatatgcctggtgtttgaatggatgtgcctctctcggaggcagcaagcagcatacccatattataaagtttttgattttctaacatctgaagacaggcatccagccttgcagaacagccaggtgtctgttctatagactacagttccttgtttccagaattacggtaaccaaataatacacaaggtcacctgattgcacttcccaacaacctgaacaaagagcacctttgcgcttgctggtaggtgctgtaccagactctttgtaatctgccttaggtcagagaagaacaagccattaccagtatgggagtccatccctagtcagggctagttgctattatcccttgaatactctgcaggcatcccacaagacatttgagacttcatatttgtcaaataatagaaatctggctggcctagtggctcatgcctgtaatcctaaccctttgggaggctgatgtgggcagattgcttgaggccaggagtttgagacccacctgggcaacacagtgacatgttgtctctacaaaaaatttaaaaattaactaggcatggtagtgtgcctatagtcccagctactccagaggctgaggcaggaagatcccttgagcccagtaattcaaggctacagttagctctgatcctgccactgcactcctgtcttggtaaaggagctaaacccagtctcaccaaaaaaaaaaaaaaaaaatcttactagagatttgggttattacaaaagggatcacttaaagactttatgtcttagagacatatttcttcagctggataaacagtccatataatcatacagtagacaaagcaaaaggaagatcttagtgacagcttaaatccaggataagaaattaggaagctgcctttatagagacaccagtacttgccctgaaccattttaattctcctctgttttcataatacaaatttgggatgttttcaaattcaacagaccagcagtgctgttgattcataacctaaacaagcttgttaaccctttccaaaataaagtcactctgcttcttgaactcactagaggtgtgctagttttacaagtcttcagagtttattatgttccctggaagtgtgcctctttgtgttaaatctaatcgctctggttagtattttaattttaaacaatcaacagccttgtcctcaaaagcaaaatgaaagaaagcaagcctttggacatgttgtctgatctgcttgcaacctgtctcccaatgccctcccctccctctctctgcctcctgcctagctttctgcttgtctttttaaactctccaaagtcaaatctttcaagggagcttctctcttgggccccaattacccctagatttattgtctctgaactcctgcaatataatattttccccttatcgcagcatttatgtatagacagtccctgacttagaatgacttaagatttttcaactttatgatgggtttatcagagtagcaaatgcatttggatttacaatattttcaactaaaaatgggtttattgagatgtagccccatcataagtctagaaacatctgtaatgtaattatttttgtctttccctcactgaactagccacttgaagacaggtgctatgcgtttaacctctgtgttccaaccctaacaatgcttgttctcagtaaatgtttaatgattgaatggatccctggatgaataaatacttggatgaatgctaagaaaaatgaaaggcttattgtacctttccaacatgttgacttatgttggcacatcctaaattcaaatgacttctctaccaccaccatccccatacacaccctggaaaaaatagtaatagcatgggtggcagggggagggggcaggtaattctactgtccttgcagcaagctaataatggccacattaattccagaatggtctatcctgtgttcccaatacttagcacttgaatcatcatcattgttcactctcaggcaaatcaggcaggacaggattcactgggaaataaatgctctttttaagttcctggaggattattatagaatacagtgaggcaaagattctttaatgttggaaaaatgaaacagtacctctgtaattaaagccaaaagccgtagtgtaaatgaggaaaaatggtaatcagcctaagctaggaaaaacctcggttcaaaatacttaattttctctgttctaagaaatcaatgcatacttgtgggtgttttaagatcaaaatgatttagaatgttttcctatggcatttatgagttagaacagagagttagaactatctctgaaattcatttcctttctttgtaaacaaatatggttaacatttactagaggtgttcattcttctctaacacatatgattttgatgtatgttgcgagaacagcaaaaatcattattaaacatctacttttaaattttctccccactgtgattatcatgcaggccatgagcaggctaaattagaaagcattttggaaaaggaagagttctcccctgcctgtgagttctataattacttgcccttattgtattcaccactagtttaatgatgggtagggtatagtactgtttgttggttttctctcaagtatattttaaagtctgcctttattttgggcgacatcatagatcaaagtttgatcctcagttttacaggctcaaaaacaacttcatttcaacaatactgtgcagaaaactgaccactattcaagtattcatgatgtattaatttacgatggaatttatgcttggctgaagaaatggattagttgtctacagaaaagtaaaattcaaaggttgaagcttctttgtgatatactccaagaggagacagaatataagttctgcaactatgttgttcttttcaactattaaaaaaaatcaaattttaatgctagaaatactttatttgacatgatccagtctacggcacaccttgattctgcagaagaggaaattggaaccctgagtttttaacactatttagtgtcagagctgagactggagttcaactgagactagagtctgagagaacacagatctccattcaagaaatacccttcttatgtagtcataattgtaataagaaaagaaaaaaatttttaagaaatactcttcttagacattggcctgtttgagagatctgtgtacttctcataacccttgctgcctccctgattttggagtgggattggtggtcagaagttggaactacagataatccaaattttttagtgactgtaaaacaaaatatgaaaaaaatgctctgtaaaattggagaaaaattaaataggaaaaaagggatatttccattcagctaaagtcatctgataacatccctttctctccactttgggagagaaactggtatatttctaaattgaaaaaaaaaaaagaggccaggcacggtggctcatgcctgtaatcccagcactttgggaagctgaggtgggtggatcacttgaggtcaggagttcaagactagcctggccaacttggtgaaaccctgtctctactaaaaatataaaaattagccgggcgtggtggtgggcagctctacttgggaggctgaggcaggagaattgcttgagcccgggaggcagaggttgcagtgagccgagattgtgccattgcactccagcctgggtgacaagagtgaaactccatctcaaaaaaaaaaaaaaaaaaaaagtcttgatgtcttgaataggagacatcaaaacataaagtatctgggttactggttactgaaaaggaatctgaatgacagactcttttcattttttaaattttagattcagtgggtacatgtgcaggtttgttgcatggatttattgcatgatgctggggtttgggcttctaattatcctgtccctcaagtagtgaacatagtgccctataagtagtttttcaactttaccccttcatccttcccccttttgggatcaccagtgtttatccccatccttgtgtccatgtgtagtcaaagttagttccacttataagcgaggacatgcggtatttgattctgtttctctattaatttggttaagatagtggcctccagctgcacctgtgttgccacaaaggatgtgatttccattttttatggctgcatagtattccgtggtatatatgtaccacatttttcttatccaatccaccattgatgggaacctgtgttgattccatgtctttggcattgtgaatagtgctgtgataataatatgaatgcagatgtctttttggtagaacaatttattttcctttgggcttatacccagtaatgggatggctggatagaataataattctatttttggttatttgagaaatctccaaactgctttccacagggactgaactaatttgcattctcgccaacgtatataaaaattcccttttctctacaaccttaccaacagctgttattttctgacattttaagattggtatgagatgatatctcattatggtttttatttgtgtctctgatgagtaatgatgttgagcattgtttcatatgtttgttgactgcttgtatgtcttcttttgaagtgtctgtttgggttttttttttttttttggtttttctttttgttgttgttgctgttttgagatggagtctcactctgttgcccaagctggagtacagtggcatgatctcggctcactgtaacctctgccttctgggttcaggggattctccctccacaaccttgccagtagctgggattacaggcatgagccaccatgcccggcctttgtgcaatttttaatggggttgtctgtttgtttttctgttgatttgtttaagttacttatagattctggacattagtcctttgtcagatggatagtttgcaaatattttctcccattctgtaggttgtctgtttcctctgttgatagattcttttgctatataaaagccctttagtttaattaggtcccaattgtcgatttttgtttttgttacgtttgcttttgaggacttagtcataaattccttgagtagcccaatgtctaagaagggtatttcctaagttttcttctaggatttttgtagtttgggagttttacatgtaaatctttaatccactttgagttaacttttgtatatggtgagagttaggagtccagtttcattctcctggatatggctatccaattttcctagcaccatttattgaatagatatgcttccccattgtttatttttgtcaactttgtcaaaggtcagttgattgtaggtgtgcaactttattttgggggtctctgttctgttccattggcatgacagattcttgactctcactggctacctaaatgatcatttgtcattagtttactggatttttttctgtatagaacaaattgttgaatttattttaactatttatattaaaaatcaaaaatcaatgtggctttaattagaaggtccttggaatttttttataaatttgatttttattgttatcctcatcactaatacatttacaaatcacattttaggtatttctgaaaagatttcaacaagtatcttctctcatcatttattcattcgaaggtattcattacatagatgactgcattaagttctgagggtacaatggagaaccaaacaggaatggtcccaaacagaatgcataaaatcacagaggttgcattttactgtgggaggaagatttgaataaaataatcacacaaatattgttataaactgtgataagttctacaagagaacagtatggggtgttgtgaatgcgtaatcagaagaatgccgtctaattgggggaattcctgaggaagtgaaatcagatggctgatgaggtggcaccaggcccaggagggactctccattcaagaatagtgttccagccaaagggagcagcatgtaagggggagagggcagcacctgcaagataaatattcatggaatgactgagttaatgaatgtgcaaaggcactgaggtggagactggaaatcagatgagtggagctagatatggacagtgaaggaggggtaatgatgaccttgaaaaagtgggcagaattcaggtcatgcagaggcctgtaagacaagctaagatttaggtctttatcttgaaagtagtggtaatcattaaagtgttataggtagtgaagttgcatcttctattatggagaattattataggagaggaggggaagagactagggagtgagctgatagtgagatttttgtccaagtgaaggtgtgatatcatggtgttttctttttcttaacttttattttaggtttaggggtacgtgtgcaggtttgttatataggtagcaaagacttaaatgattattgtgttttcaactaacatattagcaatgtacttgaagagaagttggaggttcaagagataattctgaggtgatattgactagacttggtgatagattggacttggggccaggggaggagagagaaggggtcaccctaggtggcctgggccatcctggtgactcagtatctatagatgattcatctggcactctcctgctccagtaatgccacctctagtactcacatctctggtcccaccctggactttgccactgtcctaagctactcactgctgaaatagaagggaactacaaatatccttgtgcttccagccacctcacatccaggtttctgagcttgctaaggagaaccatgtacttgaagaagttactgaccctctctgaaggctcctaggatgaaggatggtaattcctaccttattagactgttggaagatgtggacgacaatgttacaaagactctgatatagtgtgtggcacatacataaacgcaatgagatagaaatcacctttcctctttcatgtgctggttcttatatcttaaacttttgcgaatcccactaactttgatttgctactgccataagtatgtttttaattcaggacttaatttgtcaggattttatacagaagttgccccatcacacagtgtattaaagaaatgtatttatcattaattaggcaataactgtgcttttagtaccaagagggtgcccttttcaaaaagtgtagctatgcttttaaaaaaaaaggtaaatcctcagtatgccactgacttcagttccataaactaataatttaataaaatgaaaatgacccaactactactatatcaagcctattaatttcacacatgtgtaaaatctgtaaggaagaggaaatagcatgtaaactggaaagataagtgtcttgattcttcaagggaagaaaagtaggcaagtacagagaactctgtttcttctgggtcatatgttttaaaggaatgacctgctgtttctttcttttttttttttttaaagacagagtcacattctgtcacctcggctggagtgcagtggcctgatcatcgctcactgcagcctcaacctcccacgctcaagcaatcatctcacctcagcatcccaggtagctgggattataggcatgcaccactacgcctggctaactttttgtatgttttgtaaagacagggtttcaccatgttgcccatgctggcctcactacaaggctgaagtgatccccaccctgccagcctggacctcccaaagtgctcagattatagacgtgagccactgcgcccaactgcctactgcttctttgtgctcagactttgctattattgacaaatcatataaaggatcacaatcatccttttgccatggggaggaatatatagattcactatttttcactaaagatctgtaaataaatattaatgaattatttttattaattgtacaaacatttcctcatacaaacctagaatgtttccttatgttaagattactttttcagagaatatgaagattttatttctttgtcttataaatcccaaagttttatttgttctaaaaattacaatctatattagactaattttataaaaatatgttctcttataagagtggtgaaatttaaagtcaaggtataaataactctctgcatgaaagacatgcaaaactacctaaaggaaaccaaaattggaaatttgggatttaattttttaattttagaaaattttctttttcttgggaggccaaggtgggcagatcacttgaggtcaggagtttgagactagcctggccaacatggtgaaaccccgtctctacaagaaaaacaaaaattagctgggcatttggcacacacctgtaattccagctacttgggaggctgaggcaggagaatcgcttgaaccagaaggagaggttgcagtgaaccaagatcgtgccactgcactccagcctgggagacagagtgagactccatctcaaaaaaaaaaaaaaaaggaaaatttaatttttctacatagacatttccttgtgtactaaaattaaaattattttaacccaataaagtagtaaaatttggcatgcttttacatacattcccgggggctttaaacatgcacacgcatacatacatacacacagaattcagcttttgttgcctttcctataacatgcctttcatcccttccaactataggtgtttttaggcccagcctataaaatctgattacataccttcataccctcacttacttgggatctgagtcataggagcagcttgcaaagaaagcatcccaatttaagtatttcaaaatttctggaaagatgtattaatggcatagatgatacatttcgacccatttcttagttaagagtgagcttttaattcatagaagctgttcctgtagggaatctggtttttcctgcccttgttttctaggccccaggcaatacaggcttttctggagttcatatattcactcatctacccaacaactatttatgaaaaacttgctatttgcagggcaccatgctgggctacgacattgcagaaatccagttttcttgcttagagaagttgatggatgatgatgtgacattagggtagagcataataaggactgtgaacagggattgtgcagggtatagtattgggttacctaacccagtatggggtggtggggaggccagagaagcatctccacaccgtggaggaagttgatacttaactgataagtaggattagcaggtagtcagggaagagcagcagagggaaccacaagtccacggggcaaacctgaggagaagcacagcacatcttgaggaattgaaagtatggctggttcagtatgcttggagtggggaatctgaggcagcgggtggccttgttcagtatgcctgtagtggagaatctgaggcagggagtggtggcagatgaagcccaaactacagaggtcttattagccaaattacaaaattctgttctctattctgaaggtattagggaaccactgaaacattaacacctcccccattgccccctaccattttctgaaatgactcaataaagaataaaccttattggtgaatcaaaagaggtgccagtgccttaaggaaggtggtcaagaattgtatttagacctacacttaaggcagaacagcaccttggttcacattctctaccagttctgggaaagaagtggttcttagccaggtaaaatattcaaccacgaagatcctgcttggccttgtaatgttatgttatttctcagaagacagccttgtggcaggccacctcaactggtaggaatgtgctgtacaaagaaatcaatcaaccaggttaaggatgagatcaactttgtgcaaattcttttagtagtaaaaacaacaatatcacctttctttataaatttgatctacagcttacaaatatatatagtacattttatttgagatgcataaaaatccatggaagtaattggtattgaaattcctatttcccagatttaaaaaactgaggttcatataaataaaatgtagttacacataatgataattagcaagcagcagagctgagattcattccaagatatcagactttaaaccaccctgttctttacaagagactggctattttcaatgaagaaaattaagcttggggctggactaaaatctttatttggatttttttttgtcaaattaccgattacaagaattgatcactccatttcctttagaagtagaaataatagtcattttgctgattttctttattatagtctaagaaaaagaaatgctctgtttaaaaatgtactttttaaaacaaggttgatttgaggtcatggcaattaaaagtggcactaccagaaactgagctatgaaaaattggctatgcaataaatatgtatatgaaattcttgttttcccttttcttttatccttttttcttttctttttttttcactgtgaccttgaactcctgggctcaaacgatcctcctgcctcagcctcccaaagtactgagaatacaagcttgagccactgtacccagccctttgttttccattcgactttcatcacaagatgggtgacacaggacctcacctaaaacttacttgctcttgataaagttgaaaattttctgttgggaaagtaattcgggagtgtggacccacatcatggcaggcattctaggccacaggacttaactgtgttcatatgcctcatatttttaactgcctcatattgtaactgagttaggcttcatatgcctcgtattttaactgagtgtagctctatgaagcaggtaccatatattttacatccttttatgtgttcacagagtttccaatatagtagacactcaaaaacttttaaagaatagtatacaacattattttgttgaggaaagattaaaatatttggaaggacttccctaaatttaggcaaagccttcacttggacccatcttccactttactgttttcctgttcaagcagtggtctgagattcagggatcagaggaactcctggtagaattccaatcattagactacatgagtggccatgaaacactttggaggcaagaccaagcctgttctgttcactgcctgcatggagcctacagtgcattaccaggtggacacttagctattagtatttactcagtgaatgaaccaaagatgattaagagagaacttaaattgctggctggttagaatctggatttacgtaaggataaagttgctagtcctgctgtatcaaataggatggcttctacaatgctggtcccttggcaagcaattactagtttgccatataattcactgtcgttgccggttgagtgaaatggggtgatgctaataaaaatgctgagacaacaggctaacccaagaatcccactcaaaccaggactgtcacaagcaaaccaggatctgaggttaccctagtgattgcccaaccataaatccaacttcagctcttattccaaaaaagtgcttacatgtgaaagcatctcgttacataattaatgggttggagaaaaaaaaaaaaccttctgtagaaattgtaattttacaaaagtttatatccaagctggagtggttatttctgagtgctaaaatttgatatcaattttggggggcttctctgtattttctttctttcttgtttctccttctgcaataaatacgaacttggtttccttttcaatttttatttttttaagttaaaacatctattgagtcttagtgttttgctaataaatcaatgattctatagaacatccttagagaactcctaggtcccttgtttcactgataagaaaatagcaacaaaaagatattgaatgatttgtctctactaaaccgtcatcagaaaagagtattcgaaaataataacataatcttttgacagtatatatgctggaattattacaatatttatttctgtttagatgctatattatctcaaagccataaatgcaaaaattccaagaagtatgatacctcaaggaatatttatctgctagtgagacttcccagaattcgtcattttgccaattttattggtaaacttttttttttttttttttaaatggagactcactctgttacctgggctggaatgcagtggcaccatctcggctcactgcaacctccacctcctgggttcaagcaattcttgtgcctcagcttcccgagtaactgggattacaggtgtgtgccaccacacccagctaattttgtgtttttagtagagacagggtttcaccatgttggccaggctggtcacgaactcctgacctcaagtgatccaccccccttggcctcccaaagtgctgggattacaggcgtgagccaccgcgcccactgtattggtaaacttcttatctcttcagggcatagtttacacctatgtctttcggtaccgcaaagcatagcacgagaagttgcacatttctgtaagagtctacgtggactatatcattgtcttagaatggagtcacatgagaatgtttctaaaacaagaccatttaggtcacctttgatacgaagttccattataatgaagtcaataatatatttaaagtttttgagtttttttcctgttatttgcagcataaaagatttagaagcccagtatatatgtatctttggcaaactgactcccttcagccacttgtgggacaagaataagtcaggaatacaaaaatcgggtatctctagaagggacattggtgtgagataaggcatctcatttgcaggaaagcacaccaccctagtcttgcattgcagagaatgtgaagtttgcagtgtgcattcagtatttctcttcaaatggaacacctgattcagtttgtagtttaaagagatttaattgtgtgctatatagtcttttgctctgaataaggaaaataatgattgaagtggatgggttagaaggagtaacatgtagttatcatgtagttatcaaactggctgatttaatggaccaagtcagattattcccctaacctgacacctttttttgacactagtacatgttacatagttcagcctgttctcaccactctctctattgtaattgtggtttttttccagagacatcagttacttctgaaatgaacaaatgcctctttctctttctccttgatgtctgttttgacaatgtggaccacctcattctctgggaacaaaatcttcccttggcttccctgatatagttgtggctgtccttaatctgacttgcctgaccagtcagttgttccttgtttacttcactggttcttcttcctgttcatgtcctccagctgtgtttaatcctgagcactcagctttttttctctataaagtgtcttctttaaaaagtcatacacccatgtggcttcagctttcaccactacacagctattttctacactcacattctaaccttgccttctctcttcatcttcagtggggtacttaacacatctcacatattttcacctcaaacatgtatgaaatttaatttagcttctacagcaaagtgatcccttctcctcccttattattattggaatggggtcatcaaattttcccctttcatcatcatcaatactgttctttggtcacctatcactggccaattaaacttatccatacaatgagaaagatatctgaatgctaaactcttaaggccttgttttcaaaaaggtaattaaaggacactgaccaaaactatgtttaagactacttataacaagatttaaataaataatcttatttattacagcacaatttggtatttttgtaattttttaaaaaaattcctattgaaagacaataccaactcaattcttttctccagtttttattaaaactttttaaaaaattatccttggatgccaaaccttttctatattattaagtcccacctcaataccatttgaccacctccaatcttctctacccctcaatccaaccacccagatttgtacttcggaaagtttttaaatctgggaaactatccaagcagggttagtggggtgagggagtttggattcttgtaatctgttaaaaacttacttttcagttccttctttcttgtcagaaatagtctggctcctgataagtcctatcatgactgattagcgttccatgctttgaaacttaacagaatcatgaagaacactgagagtctcagagacaaagcactgtaaaataggctcaaaaggaaaggctgaagaacagggatcagattatctggaaatgagattactgaagcatgtcctaatacttaccttttcacttatgggtatttaccactaagagactctaacctaatgtttcttatgtccataagtgacacacagagaaatatgttcttaaattccagatagaaaccttggtgtataaaaagaagaataccttgatgtatactggatatttataatttaaaaactacaaaattgttgttcctaggaattgcaaaatttagaatagacatctgtccaaaccttaaaagtgaaggcctgctgcctagatatttaatgatagacatgtctgaatcctgcagacttcttttattatctctactagttttgaatagtgtcccctaaattattaagtaattatagaagaatttgacaaacccatggtgaatactagttaattacttaaaccatgcaaatattttaaaaagcatttgagcaataattgcttacacagatttccaagtatttcagttgtactaacctatagctatcaagatgaactcacttgtttcctttttccatatatttaatacacagttagattgtggattcttattataaataagaccatcaacaaaagcaatattgtaaataagaccatcaacaaaagcaattttaaatgaaaaaaactaagagtagtttttaaagatgaagcaattagagattaaatgcctactcttcacatacctgaaaaatatacaaatgcagaaatactgtatatatttgttttttcaattctgtcactggcacaatatccgttatctttgctgctaagtcattggtgatgcaaaacagcagtaggtcagcagcccaagagctgtttgaagccagaaacaagagatcacaaagacttcccaggggtgtctgccaaggggacagcaaaagcaacaagccctctaaggagatgtagccacaggaaggagcatggcagtatgcaaacccggtttcagcagaaaagccagagacagccaggatgtcacctgagggctcagcacaaagtgaccataccgccaggaagacaccaacccagaaaagcattgacctggccaggaagggatgcttcattctgccatgaagccgtggcacatgttacatgttgcaacagaaagactaagctgaaacaaaagtagtattgaacaactactgaaatacctagctatagtggtgatagaattagaggactgaaaccaacacatccctcagacccatgactgtctctaccccttcctactctgtccctctgatgaaattaaaagctataattccttatttaacaaatatttcctaagctcctcctgcatgccagggaccatactataaacaaaaataaataaataaaacagtgaactggacatggtctcttactttctaggaggttacagcttaaaggaaggtcttccttttttaattccaaatttgtaatttttgagatgaagagagcataatttgaatggagatttcattcctctgagtccctcataccacattgtctcaggaatccacactgatttcgagaactcatctgaaacctgaagatgtccctcaactaggagttgttgaaccttggagaacttgtaaaaaggtctcaaaagagtgtaaagcccagcttaatcactttcctgttttaaccacttcttcccaccccaccccacttcctggttaaatttgtgcaatggtaatattgagtctttcctatctcatacggaactgataaaaatttttgagataattgtccagaatctcctgtacttattttactccttgatgacgtcaagaacatttattaactcctttagactattacgatttcatttgtgtctcactgaatgtttgctaataagtttaaattcttgaatcaaaagaaatacagaattggtcatagtgttacgggatccttggggtttcgctttgccagctggaaatctctgtggccagtgatgcctttgcctgagttttgctcaggcccactgggcctgctcagcctggcagactacgcttggctcatgctactggcctggatcccatgcctgccaagggcgagtggagtggcgaggggtgtgtgaatgagcaagtatggggtccggccactgcacacagtggtggagctggcagctccagacaccgccacaggcactggctgtctgtgaggctgtggctggactaggcatcccgcaagtagcttccatggctggcaccaggggacacagtcatgcccagaagcttggaaatgccaggacctgcagagccccaaagagggtgtcactgccctggcttggggcactcctaggtctgggctccccaaggagccacagctcttctctccttgttgcctgcaatatggcaaggaaggggtgtgtttcagccctgtttgtgttacagctctttcagccctgccattaggcaggttccaagttcttgtcccatgcccaggtagaaggaggtatgcagacaagtgggagatgagaaaggtgaagaggagctttattgagtgatagagctcagaggagactcgcagtgctcctctccgcagctggtcgtccctacgtctgctcagctctcagcagagaggagacaccagagtaggtagcttgtctccacaggcaggtcgtcccatcaagtgctcaaggctggctgaatctggagtttttatgggcttcagagggaggaagtgcatgctgattggttcatgggtggccataggtgggcctagaaaaagcaccataagttcccactccagtttgcaggactgacagcctggcccccaggcttcaggccttccccagcttgaaggtggggcctcaacaggggccttccccctctactccagagccagtctgcctcatgccactgttcatgatgcccaggccattcatatggaggggtgcctgcaggccagtgctgagctgccctcagcccccctcagcctccctcccatgttcattggcattctaagtctggagggggtcaaggcagcagagggctagtatgtcagtgcttccctgagtgtgtgcatgcctggctgggttgcaacagtgcccaggcttggcctcaactttgctgtgagattggagcaggcactgggagtgtggagaggccaggcagtgggagcgggcctgcaggggcagtggggggcttcctgggcccttgagagtgcagagatgcccaggtctgcagctgcagcttgggtggctgcagtggcacctgcctgctgccagccccccaccagctctatggagttcaaagcccagccatacctccccttctgcagccagcatctccgcagtagccactccagatgggccatcgctaccatcaatagtgggtatggtcaatccaaatattactgaggacactttcttgtttgtttttagaggcagggtctggctctgttacccaggctgcagtgcagtgatgcaaacatggctcactgcagcctcaacctcttgggctcaagcaatcctcctgcttagcatcctgagtagctgggatggcaggtgtgtgctaccatgcctggctaatttcttttttattttttgtagagatggggtctctaggttgcccaggctagtctcaaactcctggtctcaagtgatcttcccaccttggtctcccaagccactgggattacaggcatgagccaccacgcccaatctaacaaaagacttttgaaagcattttttatgattatagtaggagagccaacaaaataatcaaaatggtaatgcatagaaagaattcccttccctgtaagctttcactaggtaaagaataggaagaacagatggattatataggtccagcttctaaaacagttaagctgttatattgtaaggtattgttgtatttgtgagtaacttgagattaggagccaaatattttatccttacgtctcagtgcttgccaatgcacgtagtgggtgatcagcaatattggattaaataattgagaatccagattctctcttataattctttcacagactggcatacaaaagggagcctgagatttaacatgcagtgtttggaacggggacttgtttttatcctgaggtcagaaacctccacagctgagtactttggataatgaaagtccattttctatatttgcccagcttgggctggacacaggcaaatgtcatacaatctgcgtttaaacattcttttctttccattttaagcatttgtgtttcctgcagcacatctaaaagattcacaatatttactgtatatttctatgcttttaagaaaaaaaaacatgcagctttcacatgcaagttattttcagcaggcagttcctttcctgaaacacaaaaggctagatataaaaacaaacaagagggagaatacactgttttaacaaatgggtcctcagagatggattttaaagcatggattttgtttcccgatctagcttttaccctatcacttcacaacactgagagaaatcctgaaataaatcagtaacgtttgcacaatttttaaggctgacagttttatttttttcctgttttgtctattgctgtagccaatttaattaggtcatacccatgtgaaaagtttgttgtacaagaaaaattttggatgtgtgtgagtattttcaggaagatttgtttctgctaatgttcatgatgtcctttgcacatgaaactaattcacttattatcatacacaatttagaatattattattgtttccaaaaaaaaaaacaactctaattcaaggggaaatacatgtttgtttacttttagatcatggttagagcaattacactttatttttagcagataaaccactgattttaaaacatatttttttaacaatacagattagatgccaacccaagaagggatcatttgagtagaaaggggagaaaggactaaattataatagtattccagaagtggcagcagaaatcaaacactagcctacatacctagagcattgccctctaatttcacttttataaaagttgtttgtaattcttaggtcctgggtattttctaatagactttttatgattataccaacagaggtaagtttcaggcccacaagaaagttattgcttctacactcccagaaatgttaagaaccacgggagaatgccatttttcgcaaaatgaagatacttattcatgttttctgaaaaatcttgatgttaactccttttcctctttaatgagctgaatgccttgcttttatttttatgtatttaataattttagtaactatttaattgagattcttacttgcttccgaaacatcaggataaatagatacaagaggcacaatttaacatattttattggctgaacataaaggtcacaattaccaagctttatagacacaccattagaagtatacagtagatcctttgtagagaccatgaatgagagccagtgtaggcgatgtcaggaacagcaatacaaattttgagttgctgtctgtgacgaaagcccagcaattgtcaagagtttgactgggtcgcaaaagaatttaaagggccagcagctctttaagaatgcatgcgttagctttatccttatgtaacatttactgtgaggcaaggcatgccaaatattaagcaatctactgaattctgctgagtccctacccagtgattctattttcaaatgagataagtaggtgagatatacaaatgaaatcagaggcttgattaatgctgcccatccagaaatctacaatgtgaatggatcactattagtaccccagtttcagcattttcctaagaaaaaatggaaataagtgaaatagatgggaaaatatggtacttttttggaagttaagaagtttgctttctaaaacaaaatgtacatagctaatcagatatacttctgcaattctgttttcatgtattaataaagctagatttcagcatcacttaagtttttaccaagaaaagaatttgaagctgggcatggtggcttgcacctgtaatcccagccctatgggaggccaaggtgggcatatctcttgagctcagggattcaagaccagcctgggcaacatggcaaaaccccatctgtacaaaaaataaaaataaaaaactagccaaacatggtgaaacacgcctgtggtaccagctactgagcaggctaaggtgggagtatcgcttgagcctgggaggcaggttgcaccactgctgtgattgcaccactgcactccaactgaactccagtctgggtgacacagcaagaccttgtcttaaaaaaaaaaaaaaaaaaaaaaagatttgttagtgagatgtcagttttcctaaattacattgactaaattttttgtgacattcaaaatttgccatggtctcttgctagattcctaacatgttctgtaaattctcagcttttagtagaatttgaagaatgcttgtggaaaatcaacaatgctttcaaccattggtatggtttggttctatgtccccacccaaatctcgccttggattgtaataatccccatgtgtcaagggcaggaccagatggaagcagttggatcatgggggcagtttatcccatgctgttctcatgataatgagtgcatctcattagatctgatggtttcataagcatctagcatttctcctgcttgcacgcattctctctcctgcctccctgtgaagaggtgccttctgccataattgtaagttttctgaggcctccccagctgtgtggaactgagtcaattaaacctcttttctttataaattacccagtctcgggtatttctttatagcagtgtgagaacagactaatacagtaaatgggtacctcagagagtggggtgctgctataaagctatccaaaaatgtggaagcgccgttggaactaggtaacaggcagaggttggaacagtttggagggctcagaagaagacaggaaaatgtggaaaagtgtggaacttcctagagatttgttgaatagctttaaccaaaatgctgatagtgatgtggacaatgaaatccaggcagaagtggtctcagatagagacaaggaacttgttgggaactggagtaaaggtgacccttgctatgctttaacaaaaagactggtgtcattttaccccctccctagaaatctgtggaacttttgaacttgagagagataatttaggttatctggcggaagaaatttctaagcagcaaagcattcaagaggtgacaaagcataaacgtttggaaaatttgcagcctgacgatgcagtagaaaagaaaaacccattttctggggagaaatttgagctggctgcagaaatttgcataagtaatgaggagccaaatgttaatcgccaagacaatggggaaaatatctccaggccatgctagagaccttcaccgcagcccctcccatcacaggcccggaggcctatgagagaaagatggtatcctagacctggtccagggccccgctgctgtgtgccatgtgtgcagtcatgactctaaggggctaaggtacagctcaggccattgcaccagagggtgcaagcccccacccagccttggcagcttccacatggtgctggtcctgtgggtacacagaagacaagaattgagtttggggacctctgcctatatttcagagggtatatggaaatgcctggacacccgggcagaagttttctgcaggggtggagccctcataaagaacctctggtagggcaatgcagaagggaaattggggttggagcccccacacagagtccccactggggcactgcctcagtgagaagaggcccaccatcttctagaccccagaatggtttatccacaaacagcatgcactgtgtgcctggaaaagccacagacactcaaagccagcttgtgaaagcagctgggagggggtctgtaatgtgcaaagccacaggggtggagctgtccaaggccgcgggaacccacctcttgcatcagcgtgaacctggatgtaagatatagagtcaaagatcattttttgactttaaggattaatgactgccctattggattttggacttgcatggagtctgttgcccctctgttttgaccaattactcacatttggaatgggtgtatttacccaatgtctgtatccccatcatatctaggaagcaactaacttgcttttgattttacaggctcagaggtggaagggacttgccttgtcccagatgagactttggagttggacttttgggttaatgctggaatgagttaagactttgggagactgttggaaggacatgattgtgttttgaaatgtgaggacatgagatttgggagtgcccaggggcggaatgatatggtttggctctgtgttctccacaactcaccttgaattataataatccccatgtgtcaagggcaggaccaggtggaaataattggatcatggaggcagttttctctgtgctgttctcatgataattagtgagtctcatgagatctgatggttttataagcgtctggcatttcccctccttgcactcattgtttctcctgccaccctgtgaagaggtgccttccaccatgatgttaagtttcttgaggcctccccagccatgtggaactgtgagtcaattaaacctcttttctttataaattacccagtcttggctgggcacggtggctcacacctgtaatcccagcactttgtgaggctgaggtgggtggctcacttgaggtcaggagttcgagaccagcctggccaacatgatgaaacccccgtctctactaaaaatataaaaattagccaggtgtggtggcacacgcccatagtcccagctactcgggagactgaggcaggagaatcacttgagtctgagaggcagaagtgcagtgagccaagatcatgccactgcactccagcctcggtgacagaataaaactccagctcaaaaaaaaaaaaaaaaaagagaaagaaaaaaagaaagaaagaaaaacaaattacccagtcttgggtatttcttcatagcagcatgagaatggaccaatacaaccatgtttattcttcagctacggtagcaggactgactttgacatgctgatgttctttttctttttcttttcttttcttttttttttttttttgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgtctgcccttgccctttcattctctgtctctctgtctctgtctctctctctctctctgtctgtctctctctctgtgtctgtctgtctcattgacaggctctccacctcataaagagtacaagatgaatcacactaggtgacttttaaatcaagatgaatcacaccaggtgacaacttctgacctatggtacttggtttccttactatagcgtcacacccattatctaattctttttcttcctcaccctgtgagctagactgaccagcagtttgtgttgggaaatcagatggagtataatttgacatttctttcttcagaatctttctaatttgacatgtcagtgactgggtctgccaaggaaatggttcttaagatgctatttttcctaaaaatactttcatagctctcttcctccacccattccaactcactacttcaatcccagcaaacagagaaaagaaattaagccaaacctcttttcaatttacataccagaaaatattttagaaaacaagctcagaagagtgcttctgcagcactattggaaaatctagccaggatttcctctgtacaaatctacctcccattgctctctgcattctgtccacatcatttttatttcctgtgtgtgaatcccattgccaccagcttgtcagtaatgctgcccctagcagtggggccactgctcacattttaaaacatccctgaattcctttggccaggaggagatagtaacaaaggcctctaaaaatttctgcagtgtccaagatgtgcttggttaccatttttttataagctcatattgccctctttatattaaggagccaaggaaaacagtatttgtgtttacttcctgaaaaatggcaggaaatcaaggtacatctgtctgaaaaggaaacagtttatattaatagatggatggagagattggtagatagataaatcaatagactgataacttacctgtccagagataacttttgtccttcatagcaatatggaaaggtattttatttatgttaggttaaaattaaggtaaatattcacaattcaagtactatatatatttttagtttgaatgagaaatttttatatacagaattattaactagtaacagaaacagagtagaaaggtggttgtcaggtgctgggggtgaaagaaatgaaggattttgatcaaagggtacaaaatttgagttataaaatgaataagttcaagtacagtctttaaaaatcaacctatatctttagtatccttaattttttggaaatctagtacgatttctctatccccaaagttcttaaaatagacttatttcatcacagcaggcccaatggaaacagggacttttttaggatcaagaattcagaaatgaatcttaaaattttttttgaatggttgctcagtccagcatttgtttacatctgaactgttcaatacaataaccattagctgcatgtggctatttaaatttaaactaaagttaggcaacattaaagagtcagtttatcattcaccctcaccacattttaagtgctcaacagccacatgtgtttggtagctgccatattggagaacacagatataacacatttgtatcagtgcagaaagttttattggacactgctggtctagatgttcaacttcctagtgaaattttttaaggttcatcttttcctctcaagttcatttctaaagttctcagatcgccattttcagaaacgaagtgtctttgctgtttctcagaacaccctgtgttgataggcagtagctgtaacctgtctctcagaacaccctatgttggtaggcagtagctgtaacagtccaattcttggtccagagccaccacttgggtgctcacttgggtgttgtgcaacaggagagcctgaagtatgctctgcattcctcagaggcatagaattggccttgattcagctgtcagtgaagtgccgtcagagacattctaaaaaaccatgcagagaagggaaagtacaggaaggaaggattaaggggttgtttaccagtaacctagagggatgtaaatacatttaatcattccaggatagagctatctttttaatcattcaatcaaaaacaaggaggaatgctatgaaagtatttttctcaatttagtatatccttatagatacctactatatttaaaatcctatgtggcattttagataaaggattaggaggattcttctccatttcttatattttttaacagaattttctttgcatacatcttaccaaaaaaaagtatttattgggttaaaaattagttttcgttccccacacatgacaacatagaaatctacaagtaattcaaatagagacatggtttagaatcacagattaaattgtctcagggagagacataattttctaaagaatgaagataaaattaaagttgttttattttgttttgttttgtttttgtttttgtttttttagtagagacaggatgtctctctgtcacccaggctggagcacagtggcatgatcatagcccactgcagcctcaaacttctgagctcaagtgagtctcccacctcagcctcctgagtagctgggaatacaggtgcacaccaccatacccagctaattttttacattgtaaaaattttcgtagagatgggggtcttacagtcttgtccaggtgggtctctaactcctgggctcaagcaatcctcccaccgaaatttaaggccaggcatggtggttcacacccataatcacggcactttgagaggctgaggcaggatctcttgagcccaggtgtttgagaccagcctgagcaatgtagtgagactccatctctagaaaaaataaatttataaataagtaaaggtctagtttcaaaacaatgccactgccgtttagcaaggtctttgtacggagaggcagagatcaattgtccatttgggtttcatagtgaatgtgtatgcattcatattatggtttctttttccccccatcccaatctaaaaaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtatgtatgaacccatgaacgacattagaagtaggcactcttgctatgttacaatttatattttctttccatgaagttgcaaagtactatcagtcacccttagcacatcctgattctcatgacccattcctaatcccaggaaaactctaggatattttgttcttggcaccaaatgtaagacaacctaaaaataatttataacttgttttcaaaaaagacatactctaactaaatgtaaatatccctgtcctggaatcttgctagaacaccaagatactattaagtttgctatagacagtcgatagggatctcactgagggagttttgcctctggcctgccaaagagaccttcttatgcagtgcctttgaagcagaaactttccaaggcaacataatgagcatggtatagttctataatttccaagtgctatcacatacaataattctttgaccctcctatttactcagtcccactcaactttgaccccagtggatagttcttacagaatgagaggaaaacagtccaagaggtcccaactcatcagcatatgatactagaaacatgctaaggcaataaaagaccatgaaaccgcctgattaagggtcacacgctcctgggtgaaacagttagtggatatcattctttccagtgtgtctaaatgatatctgcattcataatataaacatagtggatattttattggtcagaaattctattttgaacattaaaagaaaaccgtaaactaatttgagttttcaaatcaaatatgcagtttaaaaattttttcctcagaaaaatgttgaactgacacttataaaaattccagtgaattttaatttctagataaccacataagcaagaaaatgtgtccatgcccagttgaagttattgaaatatttattcagaagtgcattttactttcttatagttttattgtttggctatgaagtatattgctttgctaaaacatttttctttattattttgaagttaaaattttattatatcttgaaaaatactccaaaattcctaagaataacagcatattttcatgtatcatattttacaaccttcccaaggttacatagttaagcggcggcgcaaagcagatgcaggccgcctggccttgagaccgtgctctcagccgctgtggcacaaccgcctctcgagtgctttgttaagaatggcacatcctatctgtattagtccattctcacactgctatgaagaaatactggaaactgggtaatttataaaggaaagaggtttaattgactcacagtaccacatggctggggaagcttcaggaaatgtacaatcatggcggaaggcaaaggagaagcaggcaccttcttcacagggtggcaggacagagtgagggcaagcaggggaaatgccagacacttgtaaaaccatcagatctcgtgagactcactcactatcataagaatagcatagggtaaactgcccccatgatccagttgcctccacgtggtcctgcccaccacacgtggagaatgtggggctagaattacaattataattgaattatacaattacaattgactcttacaattcaagatgagattttgggtggggacacagccaaatcatatcactatggaaaggaataagaactcaaccctatactcagattagtgcttagaataacctttgctagatattgctgaatcctgagtgaggggatgaatttgaacaatgaagcttagagtttgctaggaaaaatagacattcacataaacatgacataagaaagaataaagtaatggagagagttaaaaaatgacagaggagatgaaaaagtaacaaaaaattctctattaattcttgaaggatgtataggttttgaacaagtaaagaatggaggaaagggcattagggactgagggaatagaattagcaggagcccagaggcttaatggtgtgtggcctgttttagaaccagtgctgcagtgtggcaggggcagagagtgagagaagccgggcagcagaaggcaggcctgacaggtagcttgccggcaccatcaataatctactagagttccccagctgggtttcagcaaacaccctcccttagctattcatagtcattccgcaatgggaggatccctgacccagtatatttgggcaattgcagagattcacaattcacattagcattttagcagctctaaaatgttctagaccaaggaaacccattttgcttaatttaacctggtctttccagaacactagcaatacaatcattgtgggggagcagaacactcactgatactttgcataatattaaaatgctattcggatgccatggtaaggagtgagatttttatagaacatagtgagccatgtaggttttggaggaaagaaatggcatgttcctatttgttttgaggcaaaataactcttatgaaagtatgaagaaataaatttagaagcaatatcagaaaggctgggaggttattacagtgttccaaaagaatgagattaaggcctcaaatctggagagtggaaataaaaatgggaaatgagcttcccaacaagaggaatgccgaggaaagactgagggacaatcttccaaagctcatgcttctcaccacaatggctgactaaaagaaaagtatatagagcatttgtttgtttatttgtttgcaggaggaaactgatgagttcagatgtaggcctggtggctcctaaatattcaggtttggatcttaggtgagggaccaggataaaaggtaatgatttgaaatgcatcagcacagagatgatatttgaagctatggagatgaaaaaaggttgatctgggagactggaaggagagagaagaaaggaaaagagatgaggaagtcaggggagaagaaggaagggaaacaggaatgttatagataataccaacatttaaagagtgaattagaagacagtctcaccaagaaactgtagcaagttcagaaagaaaaacaaagaggaaggagtttcaggaaggaagaaatgattagctgcacaaaactttccttaaagtcagggctgaaaagaggctatcagactacaagtaattctcagggcagattatgtcctcagtgctacagtgtcatcagttgttgaagttatgacaccggaaacataaagtgaattcttggaacataattaaattagatctatattacattacatcttatatttatgtaactatgaagtgcatttggttctagaatgtaaggaatgtcttccttacttatagatttgtagagttccctgaactcactaggaaataaatactttaaaagaccaaaataacaatctctaatacttggttccctatatttttagaaaaagtaatgtagtaatcatgtatcagccactggacactttccctcctagaatatggtcaaataaaggtcagtctacatgccattttgtctacagcagttataactgacccataaggccagattcagcccaacaaagtgctttgtttgatccatataacatcttaacattttttgagccaatatgaaaaatacagagctattttctaaaaatatagaatttctagaaaaatctagcaacagagtctttgaagtcgagcacagcgctgcttgcttggaactgagtaatagcagcccctttggacatgagctcttccactgtctagtgcctactaggcccatgtcactggtttatgcaaacctccttggccactaggacatttgagtttgcaaaccttggtccctctcaggtccaccttcactatggcccattccaagtcaagtactaaaacagtgggccttccatgtctctttcatttgaacccctaaacaacttgtcaaagctatgtagccttttgcatgtgtttaaaaagtttttcataatcagtttaaatggtatcaaataatgtaatttccactatatcatacattttggtgtttgaaaataaaacttttacattattgtttgaaactaacccaaaggctctttgctaactaccttagcaatgcaatacctagttattcattttttaaatatgtgaacaggcttttttttataattggaaatttgacatcactttcttttctccttgaacttatatttccattctactttctccacagaattttatcctactataatatattttatacttaaaattcattttactcatatttctttccaacagaacatgtttttaaattagaacttaatttttttctgtggccataagactctaaggtgttcaacatttcttttatactgttaccattacaattattcctagtgtacagttcaacaaatcaacatgagtaacaaaaacatctgttttgataaatgattgtcaaaaatgaaaaagactcatcagaataatagatatggaaattcaagatctgggaatgtattcccttaaagctgtccttcccatactatcttgtactccttgaaaaggcatcatgtaccacaagttaaaggaatcccagcctgaagacttctacttcaggtgctttacatcctgcagaggcactgacctggagcgatgtgcaacattagattatgaggaggggcagccagctcccacattgaccactgacgttagccaaatcgttaaccacctcttctcacctataataactgggctagcacactcctattttcccttctacttcaaaaatcctacattgcaaagatttccttattctcaaataacagtttctaccatgtatctgataattttctacttgagattatgtgacaatgagccaccaatttctgcccatgtcctaggctttctggcaggcctccaatctctccttacatctgcagccaaccttagagaacactggaaatttaaggcaaaaatgggcctttggcattcaacagccattctttttaacctcctcctttcttagctatagcatcattcataatgaagttttctataaacaggtagaagataaaagctttttctgtggtttttacatcttaatagaaaacccttaaaaaccaaaacctacaaggtggaaaaaagttcatttttacttgtgggacttcagggactgtggtagcatcagatgaaagatcaaatttgaaaatccttctcaaattgtaccacctgttaatcaggtttgttctatgtacttcccttcccctaagatcctgcactaaaatatgtgtcagagagtatgtaataatcaagacagaggttaataagtctcaaatgagcaagtaggtcacaagaataggaagcatggtccatccaatgcaaattccacatagaagcaggaagggtggccaggtgaacatgtagaaataagaatctggcctagtcctgggccagagtttatgttctgaaaaaccaggattcatctcagtatccctggaaatgtagcagtgctgagtatctcagttgatgctccatattggatggatacatggatgggtggatggatggatggatggatggatggatggatggatggatggatggatggatagatgcatgggattcaggaagagtgactaggcctttcaatagccactgatactatctcctgtgcccttttaatctcccttacaattcatcatctttcagttaggaataatgttcagatattcaagcacatactaaaatgcttgcattaattcagtaggtagaatgcctttactgagtgcaatagagagaatttaatgtcagaatgccattgctctaaggggcaaggaggagacctaacactctttagctaagacattctctttttaattatgttaagattaaccatgagaaagactatatctctaagacagaaagcttaagtagtcagtttccagattaaaaaaatcatcacttctttacaagcatttacaaatgcttgtcagcaggctccaaattcatgtttgacagctacaaatgaattctgatgtgggcaagacagtgtttttgaagccactgtgttagtgcatactttgttgcatacttcaaacttatattaaaggcaagtatattaaaattgtttgatctaaaatagaagccctggcccataaaacagtcatggacttctttttcaatctaattttaaccatattacatttttaaaaatttagaaaaagaaaacactattgacgttttaagtttttaagttaaaatattcgactttctatgagaaatccacatttcactctcaaaaaagatgacataatgtccttcaattatttgttcttgaagtacatcggcacttccacaggcaaatgagacactgagttctagactagtggtatcctgattattattagttttttttttttattttaaatagagctgtctaatgtatcatcagtgtccccaaccaggactttaggagaatgggaacagtcaccctgggacagcctccattttagggaagaggagaaagttcagagcaaactagaacaaagactcaggatgagggtaggatggaaaggaatgtctccatttacatgcttaacaaggtgtgccttgagtactggcatttctgtgttgatcccaagttgacaagattcctgaaaatgtcaagcttggaacatattgggcttagaaaggagtctttcttcagcgagggcttctcccagaatgactaacctgattccccaccatccccagccccctagcctcctggtgttatcccaggccaatgacatcaatgtcatggtaaacatttccatatgggaaacctagaaatgatttatttttcagttagaagaaaatagatgacaagtccttgaacacaaatgaaaacattcagaatcaaggcccaaaatactcaaacttctccaagaactcatcaataaatttctctttgcaagatatcccatcaaaccacaatgacttatttaacttcaagaacttatgcagcccagtgtagtaaacaaagttaggtaagaatcaaaatggaaaggtggaattttgaaagattttgaattttttcctcagaaaaagatggaaggggtatggtctttggatcattgtcacattgatgtgggccactcagctagcacctctcatcctcactcagtccgtgcatctgtaaaacaggactgatactcaccctatcctaaccaaagtatattaaaatgttaagaaaagatgaagctcatgatgaatgtaaattattacttttagttcctttataattgcctgttctattgaccaaaggaaagtgtccctgttatcacagtcgctggatttttcttaaacttttggtttgaaatttaagcatggaaacacctttcagaaaatcaggatacttactgcaaactacccgcctataccatttaatgaattgcaaagggatgggagacctggtttgtgctcccaggtctcggcatgttatacttgtgtgtaatatatgccttttctgagtctcagtgagggatgagtatctggatatttgtgcatttctttgaacttggaagaaattgcaaaggaggatgatgagatgggtcagtagatgtggtgactcaagacgagtctagaacttgcttacatatcttgagttgctaaacaagctcagcatgctttcaataaggcagagcttgtctttctagtgtgccttgtcccagttgtcatcacatgctttatgatgatattcctagtgggatttagagtaggcagacactgaaatcactgggagttggtactagttaagtcattcggcctcagtcttccctgaggctaatcatggggtcctctctgttcctccctagtgcttccatatttagctcttccttgctacaggccccagggccttagtcacctccttatagaatggccactgtctcgccagttcactgaggttcttccacataacacggttctcctgttcccagcagagaagcatgggccatttgtccttcgaaggcctggaagtagacacaaatgttaccttcgggggccaagcattatttatggtagtccataaatgattgaagagggctgggtgaaaacagagacaaactgaaggactgcctggtccatgggttttttgttgttgttttttgttttgttttgtaatgcggaaatgcaggcccaatgttgcctgatcttctggttgttgtttttgttagtttttttttttttttttcaagagaaaccagaaatctgatttttttgatgtgaaatgtattaattggtaaattttagcaacttagtaaatttttaaaaatacattgtcactggcaatattctggttcttgaagaaaggagtttatgagtgtttgttaagcattttgctttatggcttatgtatacattgtagataggagtattattaaatttatcatcaaaacctgggcagtgtgagagaataaaggggaggtgattaatgattttgtcagggatgagaacttttcacattttatgtcctccagctccctattttgaggagatggaaaaataagtatctgtaaaaaggtatagagatgggccctgatgggcaggcaggaagacattcaggctggaattaacatggtgcattcagggcatcaggagacctgatcagtttcagagaaagcgctccaaaaggcaatggttgggatacatctatttgataggctagagacagattaaagactgatatgaaagccaaagcagagggttcccaactcagtgtaactggcaataggaactaacactcgttcttgagaaggagagggcagtggaatacagaacagaccagaggaacagaacaggagatgagatggagcaggcaggttcacgacttaggatgcagagcacagtttaatactacattcagcacacatttgctgaacacctgcagtgtactgagcactgtcctatgagctaggagacagaaagataggaaggacataatccagtgggggggtcagaaattttaaaagagaatcatcatgtttcaagggatagcagagttgatattggtaggaagagtggaggcagccagatgaaggaggtgggaagtgagaagagcaccccaggcagaggtgccagcataagaacgtcgtgtgaaaaggcagtgacctgctgctccgtgtcctgagcttggaaaccctagtgagacattaggagagagtgcaggcaagaggatcctgcaggccttgagacagggcagaaaacaaggcctccagaaatgaggcagcaggaggaagtgtatgagaaagcagaatagatctagaaagagccagcagatcagaggataagatgggcaagtaccatgtcacagaagcaaagagaggaagtggagtttcaacagcggcctttaacagagagagtgcgaaggtcagagacccagaagaaggagggcttggctagaaggtcactagtaggctctggcttccatctccagataggctaagattaagccaattcaccattttcccacaactgtcaactctgcagaattgccttttcttcctctcagacagaaagggaaatcccagctgcctgagcaaccggtttttcactttcctccttgtttgcagagtctagtggggctggccctggtaacctctggtgattcatccagcacaccctatgaccacatccccattgtgtgtgtgtagagaggatgagagtttatgtgttcctctgaacgttattacaaaagaaaagaacattgttctctagaaatatgaaagaaaaagaaaagaacaaggtgttactctagcatagttttttctcaattatctgagttgtgaaaaaaaaagtaatgaatagtggagcttcctcaaaacagattctgagcgctgtcagtagttaacagtaactactgtggtggaattcctgtgtggatctattttggcactgtgttacgtaattatttttatcttaggatcagatctgaatcattcaaagccaatgtcttcagggcactggtgtgactccaggtgttctcacatgcctgtctttcttctcagatcactgcccaacactgaatctcaagtgatggacctcagtgcatatgaattcggggcctatatgttttgtaacagcaaatcctaccccactggtgaaaaagtctaataacctgactgattttctattttgatgagccctcaattgagagattatattgtggtagtaggttacacctgcccaccatgtgaaaaacaaacagtaaagattgagaacccaaatgtgtgtctttagaaattaatccgtacaatttaaaaaactgccaaaggaaatgtaaaagatagtttcataattgttaggtattaataatatctattctaaatgtatggcttattttttactaatataatagaaataaacaggcttggacctaatgtaaattgattcttaagaattcactgcactaatagtttggatttttgtgttcattctatttctgtggcaggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 2403 - DNA, 605418 bp, Homo sapiens; identical to SEQ ID NO: 2402

SEQ ID NO: 2404 - DNA, 429348 bp, Homo sapiens
ctcattttcatatcaattggcagaaattatctttattagaaaaatgaaattttcctgtatttacatttttacaccatatgaccgggcacttctgttgcctcaggagttatatacatatcagtttgcacacgaatttcaatccccattccttaaaacagttgataacacattgaacaaaattaaaagacatactacaagaagacaaccatagtatatacttcctctatcatagaaaggtgttaagcaaacatataattttgtagctatgcttggaaatatttaatacacttattagcacttcctcatgcagtggattaaaacatgacagatataaactgctgcagttgatcagtgaacattaattcccaaatgaagaccattgcttagagcagacagcttgctttcagctccaccatacaagacatcaagtcagttctgatgtgggttttggattctgtttgaatgtagctgtgaatagaaaccctctgcatatggagttcaatcctagccttgttgggttaaaaatggactcagacataaacctggatagctgcttaattcaataactttcttgcaggcaatgaccagcttgtgtattatgcaacaagtcatattattaatacgtgagtgaaaaatgaatcatttatcctctttgagaaggccattatttataatttttatgatctaattcttattcaagctaccaagaaactcaccttattctttctgaacattcagcttgaaatatatatactatacataaacatatacacataaacattctggggtgatataaactatggtgaattctgccaattaattcagcaggtttatgcttttaaatttgttttggcaggggaatgaacaagattaagattcatagttaaaaacaactggtaaagaaatctttggggaccctcaggtttggaaggcatctgagccacatctaactatgtcactgctgtgtcaagcagttttctgaattttctatgaaaatgttattcttgaacttatatcttaagtaggcaattagcatcccttcccagtgaaaaatttggggaacatgaatgttaaaagttccactttcatcttttcaaattcatcaaaaatttcaaacaagatcacctggatttggctcaaattagaggcctgaatcttttgtttttaaactgaaacatttacgtaagtggtcatggccccagagcttttctacaaacttaataaactaaagatttaaaaaaatttaaaaaagattttaaaagtcaatactgttcattcacttgaattagcttgactgagaacagaaataattaaataagtcttagatggctaatgtagaaacttcgattgaattcaaaaggctatgattgtttttcatggaaaaaaaaagacaatgttttcgtatttctggatcttcgctctttgctcagttatcaatagtctttgatttgagccctttaaaacttgaaacagcaaaatgtcagatcaatgggaagcatttaaaatgccaaagacaaactcatgtttgctggagaacaattaacctcattaatttgaaaggcagctgtggtattggctatgagttatgttaatatcctattgaaggttcatcttaaatctttcctaaaggtgtgaaagagaattaactggaagaggtcatgacccagggctaatgaagaatgttctaggattgcaaaaatgcaaactcattgtttcactgacatagtaagtaagagaattatgagtgataatctcagttttgtcttcttcgtttctgcagaccgctgacactttatctgaggaagttaatctgaggaatgacttcattttaagcaatttagttctggttccctggagagttgcatgctttgaaatacaacccccagagaagaaatgctattggtcaaatcgttctttggagtgctccatttctgcatagctcaacattccaaggagaacatggtcacgcacttgtagacccaacaacaggatctccaaataacaaataataatctttctgtcttaaaaggctttttactgccagcttgaaagatgaaaacagctgagaaatttttctcatagactagcacttaacttgcattaagttagctaactctccagagaattcatggagactcccagaaagacattccttcaaatccccgctagtgtcctcatccatcaaatgggcctaatgcacccctcacctctcagtaaatataaatgccaggaaagaaatgtggcttagaccatggagaggggggaatgcaggaaaggcagtgtgtgctcaggggcatgcctgcaggatatgttaaacattaggccattctgggtacctataaagcccggtggaagcgttccagttcaacactcttcagtgggacagaataaccgtcattatcctaatgctaagtgagccgggaattatctctaagacaatttggaaaagaaaaaaaaaaaggaacagaccaagaaggaaaacaacaacaacattttaatagctggtcctcaatcattctgactaccaaagctctccatcattcatgcagaaactctatttcctattccctgtcccacctctgaaactcattccatctgcctggcaaagataaccaaacatagacatgaaataggaggaatagtcaacttgcaaataatatcacctctttgaacatgggtcacaatatttaggaggactttaatggagggtcacatggctgtgtgtgtgtgtgtgcatacccacacacatgagagcatgtactatgtatatatgtttaatggaattagccctgatgttgactgataaaaagatgagacattaggaaagagatatttaagattaggcacatgctaagtagagaaaataactccccagaaatttttttaaatgctaagtgcaagcatatgaaagggagacacaaacagtgttcaagtctcagaaggaactatgaacagaggtgagatccccagaagttctccatacacacagatcaggcaatgaggggtaagaccctaacagacttccctgtcacagaggctgatactcaagggtatatgcccaggaacctcaaaagagcacacctctctttctgacttctattctgacctccctggaggagaccaggcactttgaaaatatgtctaacgttagggatttactagctaattctagttgctgacgaggttgagaaaaacctgagcctcagtttccttatctgtaaaatgggagcaatcatatttatatcttaaggttgttttgaggatcacattctaggatatgcctagaatatcgcctacactcaatttagatatattttgatattttcaaattcaggtgcagatccatggcaagtacttgcgataagcagaaaatgtaacattccaagaatgcacagaatgggatagacagagtgacaaaagctccctctccacctcgccatccttcctgaaatacacctctattccttttgccatctctttgccccgttttctctctagggaacctgatgctttctgtcagccacagcagtaggcacttggaacttgataaagaattttccctctatgcttccctgatacattcataccctggtgtatcagaagggttcttcaaatgtcaaaaacaaaaccaaacaaaaaagctttagggaaatgcttcgtctttttacatcatggtctattttctaatcctttggggaattttttcaaccttttcttgaggcacatgtcataatgcaaggctgggaggaggcatgatttggcaaggactggagaactggttggaaccagacaaaagccttcctgtgcaaaaatgtaggagtgtgagtgtgttcacctggttagcagctcctgggtctcctaagtccattatttgaagattaaaataaatcaactgcatttccgggaccactaactctattctccggagttacttaaaggtttagggaaggactttttttttttttttaaaaaaggtatgctcatagaatcagattattttttttttcctggctacaactttagttgtcatttctaatttttgctgtttagtctctgtttgcattgcatgggtccttggttatcctttgtattagagaactgaacttctaaaccataagctacttatgggaagagactatattttctatttattttgcatcccctcccccacaatcccaaactggctttcaaaataaagtggacattcagtgaagtcctattagctggtcaatgtgcttggttcttcctcaatgcatgatacatagacctcaattatttcaatggtcactgccagccttttatcttcagtttgaggttttaaacaatatccctgttgatttttcctaaggagacggtctctgagaaaagttttctcttctaggaactttaagacagggattgtgagggagtttaaaggaaaaccaaattcaaagaagcatgggtaggtctttctggggcaagtggcaaaaacaaaaaacaaaacaaaacaaaaaccagggcagccttatggggatctctggctcttattccagagctactcaggagtttccccttgaaagaaacctagaaataagtcagcccggtcagagaatcgagccagaaattgaaccatgtcttggatctaatcctcgctctgatactctctaacttgatgatcttaaacaggcaactgcccatttgtaaacttcatttttctcatctctcctccccttctcctaacttttggtgtggttctacgaactctatttttctaagacccttctgggcaggcacttctagctaatactatactgaaagtactgctgggcacagaaagagtgcaggtgaggaaagaggataaggaatttaaataggaaatctatgccctttgatgtgtttaaggaaatcacacacaagtccatatcggcattgtcttcagaagcaaatgcgagcagaatatattctatacccctcatcccagagttttgttttttaaagaaggggccaagaacgccaacacccatattctacttaggctctgtcatcctccctacaactgagattaaaaaaatatagtgccctctctacagaaatatcctcccataaaaataaccagaatgggttttccatgtgttaataccatcatcaccatttaatttttaacataaactttacaatatgtacaattttatttggataatacacttacgtgtgaattgtagaaatcaagcatgtatattatatacatgtgtacacaagcagttgtattcacaggataagtgcatttgatcatctctgatctatatcaagtggcaagctgacctcatctgatacaattagatatgaacacagtacaatgtatagggattgaatgggaaacagtaactgcatattgggagaacttttcaagtatagaccccacagcactttcaaccctgttcaccaaaaagagatggggtatctggaaaggtctaattttgtctccagtgaaaataaacagtacttttggaaggaaaattgcctttacatagaacccttcactcattaaatatcaagcaacacatttagcttccacctactcaaacttctttttctttgagtccaatcatgtctactatagccatggttaatacaaacaggctccatttcagaaacaacgcatgtccccttttcaaggattcatgcacaacagctatgcacaaagaaacagtacaggaatgtgcataatgttaacgaatatatccagctcctctgtaaggtatttagagttctcaaattagtgtttatttaggtcttaaaccgcaagggatttcagtacaaggtacttatttatatgacaactgattattaaagctgcactttttagatttaaaggagataaatttttaatcaccatttaattaacatcaacattttttttctttttcattagcaattctatttgcaaataattcagggcatttgtcatttcctgtgaaggatgcagaatattaaatacacatcagtggtcgacatagcaaatagaataaacaatgtgtgactatatgacagctgtggatcttttgactaattaactgccttggctagagtcccatttaagtgaaactatttcatttgtaaacaaggtgtaattttctatttttctccccagaaaataagcgtgaaatgatttgacagattttgctgcaatgtgtgaattttaatgctttcaccagaaaaactaaatactcagactctctggcatcctgtgaatcagggaagagaaaatcaagagtaatccgtggatgcccagtcatggtgctggctaaaataacgcagagagatttgcagaggacataacagtaatgagtggtgagattgtgagattataatcctgcaagtctctctggcagaaagatagacctatagggacttgccagctcagagcattgaaaccataagtggcctaagaacctgcagatgtaaggatgatgaaacccattttccagaagcacaaaggtttctcaagtacagtttatgctctagaagactctcttacccagagtattttaaattggttgcatgtgcgtgctattacccatggacagagacccaaccgtttgcattcaagtgtacctatctgaggactagttgggtccttctcaagtggggaaaaccaattagaattaacaaaatatcattatggatgccagctctgacttaagccagctgaaactcaggcatttgtgttcagaaatttgggctccttgacatcaacaaatctaagaactcagagctgggatatgttacgggaatcttctgtgatagatctatagtctcaggcttccaggcttcctatttaattcttgttacttctcatactgtgggttccatttaccactggacgttacattcctgatattctttttgcaaagactgaactgacttagatgacctttgaataactctacatcttttccttagaaattgaccatctgatcagtagttgattttttttttttttttttttttttgcttgggatcatcacattgaagagtcattgaattagtagagaagggataccataaactttgtgtagcataacatttctgattatttatttgaaaaaacacttcggtcagtgaaaagaatatatatttttttcacaacattactgttgattcttccaaaggccacgttttcagtttctttatccagagatgtatggggttaatagcagaaataatgctgctgttaggggaaggctttctgaccgatgaagtcagtccaagtataactctcactctccctggaggtctctgtggcatttggcagccccctgggtttagaggacaccagaggaagacagaaagcctctttggcttgacgacaaatcactcttctgtattctgggaagactttttaattcattcatgtcaaaacatcccagactcatgaggaaatggaggcgatccttgctggggtggattaaggtctggaatgcactggaagggcagaaggtagaaagggctaaaaggctacacagtcatggagattcagatttaggatcagatgttggggtgactattctgggcccttcgatccaggcttctccatggctgggtcttggggcagcagaggtacagcatccgggaaataaaatgtcattttcaagcacatgcatccccagcacctagtcagccccttctgcctttcaaaaatgaaaggaagctcctctcacccactgcctccctctgtctccctatgattgaccctgaaatttattgcaaccacttttcattataggaacactgtaggtcaggtgtactttcccaaagatggagctattccatgcatccttgagctttaagggaatcatccctgacacttgcccacatgcaagaaaataatacttacaaaacagaacgcacaccatgaggagaagaaatgggataatttttcaacctgccactttatccctttcttcaagaatgtaaagcagaatgcaggaggaaaccaggaaatggccaggcgagtctacattagcttagtgtttccgtaatggcccaaaacagactgaggtcttctgcaaacactgatggctagttatcccaaatacttcaaaaatattcatgtacatgaaatacactaattaacagagtagaactatataaaaggtttagttaatattatttgctggttttatgatatttaatttttaaactagaaaatcctgatctgagaaagtgtcataacatagcaactatcttgtcgggggcacttgtttttgtggcaggcactgtgctaacaggctccccatgcataagtattcccctctctgtctctaacttaaaaaaaaaatggatatcatttcatgtcatatatgcacaggtttgaggagaataagaatgggataatgcaggcgactcagaaatgacaaatactttgaggaatttttcctacatctctgttggtgctatgaagtggtttgccaccaacagagagaataactcagaagggagaaattgcttgtctcactaaactgtatccacagtttggaggatactcagggtagatccaagagtgcctcgtgttttgaaggcttttgatttgaggagtttggggtggaagtgagtgtccaacagaatttctggatgtgaaggaagataaacctaaaaccatgctagccttcggcagacagatggcattgtacttcttacagatcacagtacacatacggctgttggtgcatgtcaccacattaacaactctgggaagagcgatacacagctaattggacaccaccatggctgtttggaaacggaacgagttatggttactctgggagggaaggggtaacagatactatacaaccctgagtcatcaccagaagggaggaaatgcaaacttacgtacataggcgtcttcgggataaactacaatggccactgtgtcacagacagaagatccacacttagatctcggagacataaatgtgttagtttatgcagctctgaacaagaccatcgaagccgagggtgagagaaacacacatcaacatccaaagagattcctgtagctctccccacctgagggtccctcgggcctttggctccagatgtgtcttggaaatgaactataatgaaggtagcacagtcatcacgaacacactgatttgctattctttaggggagcctggagttcttggggtgagcctgggctgtgatggaaggcataacaagaaagctgaaactgttacgagccaaacttcctaatctcttgcacatgtcaatcgcactacagtgcagatgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgat

SEQ ID NO: 2405 - DNA, 419394 bp, Homo sapiens
atgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggct
